United States Patent 7,396,979 (NUCLEOTIDE SEQUENCES AND POLYPEPTIDES ENCODED THEREBY USEFUL FOR MODIFYING PLANT CHARACTERISTICS AND PHENOTYPES) - sequence listing, part 2

SEQ ID NO: 2332 - protein, 485 aa, Zea mays
  misc_feature (1)..(485): Ceres CLONE ID no. 234510
  misc_feature: Utility: Useful for making plants with increased biomass and foliage
  misc_feature: Utility: Useful for making smaller plants
MMMMMMAGEHVLAALGTLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGSSGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 2333 - protein, 480 aa, Zea mays
  misc_feature (1)..(480): Ceres CLONE ID no. 390429
  misc_feature: Utility: Useful for making plants with increased biomass and foliage
  misc_feature: Utility: Useful for making smaller plants
MMMMAGEHVLAALATLLLASLLTLVLNHFLPLLLNPKAPRGSFGWPLLGETLRFLTPHASNTLGGFLEDHCSRYGRVFKSHLFCTPTVVSCDQDLNHFILQNEERLFQCSYPRPIHGILGKSSMLVVLGEDHKRLRNLALALVTSTKLKPSYLGDIEKIALHVVGAWRRHGGVRVVAFCEEARKFAFSVIVKQVLGLSPEEPVTARILEDFLAFMKGLISFPLYIPGTPYAKAVRARERISSTVKGIIKERRSAGSWNKQGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFTAVHLNPSLHGDAQQFQPCRWEGTSQGTSKRFTPFGGGPRLCPGSELAKVETAFFLHHLVLNYRWRIDGDDIPMAYPYVEFQRGLPIEIEPTSPES

SEQ ID NO: 2334 - DNA, 960 bp, Arabidopsis thaliana
  misc_feature (1)..(960): Ceres CLONE ID no. 102248
  misc_feature (1)..(960): Also known as  Ceres CDNA ID no. 23363381
tctgtctgtaatggcatgcttagaaatgtacaactccaatggtggtggtggaactcccatgagtcctagaatctccttctctaacgatttcgttgagattaggccagagacgaccaagacgacgagatcaagccctctctctaaacaagagggttcttcttcttctttttcagataatttcgagttctctgtctcaaactacacaatgatgccagctgatgaacttttctctaaaggaaagcttttgcctttcaaggaaaccaatcaagtccagagaactttaagagaagagcttctcgttgaagaagacgaagaagaaggtccacgtgatgctaccaacatcttctctctcaagccaccaatcttctcatcatcttcttcttcttcttcttcttccaagggaaggtggaaagggcttttgggccttaagagggcccatgttgggtctaagaacaatgacgagcgatttgttcatcatatgattaacaacaacaaacaatctcaggaagcaattggtggaagagaagggtcaagttgcagggagatgaagaagagtatgtagagcttaaaaacaaaaaaggctttcacttggtttttgtttttttaggaacatggctgcttccaaatttttaaaaatttagatttatgttaatcttagatctgaaaaattactaaaaaaaaagacacttatgtgttgttgacggagatggtttatttcattaactgttttccactacacatgtttcatcgattcttctgagtttttatcttgttttttctttttcttttgaagggtgtgagtattagatctatctttgtcgactatttggaatgaatgtagtttttttttttgtcgttgtacaaaagaaaaaaagaagaacagagtgtgagtagttcagaaaatttaagttccagttgttttttaaaattgaagcaacgcatatgtctattgtcttcgtc

SEQ ID NO: 2335 - protein, 183 aa, Arabidopsis thaliana
  misc_feature: Utility: Useful for making plants with increased biomass and foliage
  misc_feature: Utility: Useful for making shorter plants and plants with modified flowers
  misc_feature: Utility: Useful for making smaller plants
MACLEMYNSNGGGGTPMSPRISFSNDFVEIRPETTKTTRSSPLSKQEGSSSSFSDNFEFSVSNYTMMPADELFSKGKLLPFKETNQVQRTLREELLVEEDEEEGPRDATNIFSLKPPIFSSSSSSSSSSKGRWKGLLGLKRAHVGSKNNDERFVHHMINNNKQSQEAIGGREGSSCREMKKSM

SEQ ID NO: 2336 - protein, 166 aa, Arabidopsis thaliana
  misc_feature (1)..(166): Public GI no. 28466849
  misc_feature: Utility: Useful for making plants with increased biomass and foliage
  misc_feature: Utility: Useful for making shorter plants and plants with modified flowers
  misc_feature: Utility: Useful for making smaller plants
MARLEMHNSMNGAARISFSNEFVEIRSEKSNAKSNNINSRSSFSMPSADFAFSVTDYSMIPADEIFLKGKILPFKETSHVHRTLGEELLTEEEGSMVDGNTFSLRPILLSSSSFSTKGTWRELLGLKRTHVRSKKTDKVNEEVLSQDHKIISGNVATRECQVADTR

SEQ ID NO: 2337 - protein, 146 aa, Zea mays
  misc_feature (1)..(146): Ceres CLONE ID no. 1061902
  misc_feature: Utility: Useful for making plants with increased biomass and foliage
  misc_feature: Utility: Useful for making shorter plants and plants with modified flowers
  misc_feature: Utility: Useful for making smaller plants
MACVDMYNPEHHHQHQPAPPSFMAPRMSFSSDFAVEPPPPAAARGGGDADFEFSVGSHPMMAADQLFSKGRLLPLREAPQQAAGGRPVTLRDELRADERHGRAPRATNIRWKELLGLKKAPKKQQAAAAAADAAAGASTDAHMVGH

SEQ ID NO: 2338 - protein, 163 aa, Triticum aestivum
  misc_feature (1)..(163): Ceres CLONE ID no. 827699
  misc_feature: Utility: Useful for making plants with increased biomass and foliage
  misc_feature: Utility: Useful for making shorter plants and plants with modified flowers
  misc_feature: Utility: Useful for making smaller plants
MACVNMYNPDGGAVAFGGGQPGPRISFSSDFSMEPPPPVQNRAMGLRCQEEDQNFEFSVGSHPMMAADQLFSKGRILPFKVEGGRPPSTLRDELRGGAADEERASTTPKGSSRWREMLGLRKSLCVGGGVASNAAAAKKSDKVVAVDADAKIATDMAAPKQEL

SEQ ID NO: 2339 - protein, 180 aa, Glycine max
  misc_feature (1)..(180): Ceres CLONE ID no. 562697
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (91)..(91): Xaa is any aa, unknown, or other
MSPRISFSNDFVDLKQAMKQEQRGSSRSDAPVSSDFEFSVANYSMMSADELFFKGRLMSTYNKDNCNNNNKNNHMMMMQQQRATTTTTTTXKEELLINDDDHDHDFSLRPPKPSSTRWKGLLGLRKTHIGSKKPHKSTEGGSSDATRSALVNDSPPTSITSSQEVLNEGGSSCRDLEIGI

SEQ ID NO: 2340 - protein, 146 aa, Zea mays
  misc_feature (1)..(146): Ceres CLONE ID no. 218046
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (87)..(87): Xaa is any aa, unknown, or other
  misc_feature (90)..(90): Xaa is any aa, unknown, or other
MYNPEQHQAAPPFMAPRMSFSSDFAVEPPPPAAARGGAAGPGDADFEFSVGSHPMMAADQLFSKGRLLPLREAPQQAGGGARPVTLXEEXRADERHGRVPRAPNIRWKELLGLKKAPKKQAAADAAAGTSADAHMDLGGQQGSTRD

SEQ ID NO: 2341 - protein, 156 aa, Triticum aestivum
  misc_feature (1)..(156): Ceres CLONE ID no. 758144
  misc_feature: Utility: Useful for making plants with increased biomass and foliage
  misc_feature: Utility: Useful for making shorter plants and plants with modified flowers
  misc_feature: Utility: Useful for making smaller plants
MYNPEHHQSSFMAPRMSFSSDFALEPPPASAPSARGPGDADFEFSVGSRPMMAADELFSKGRLLPLREAPHGQSGRPTTLREELRTDDRHGRAPRAPNIRWKELLGFKKANKKAAAAAADAGASTSSAEAAAADAGASTSSAEAHTDLGGHGGTRE

SEQ ID NO: 2342 - protein, 153 aa, Triticum aestivum
  misc_feature (1)..(153): Public GI no. 50913049
  misc_feature: Utility: Useful for making plants with increased biomass and foliage
  misc_feature: Utility: Useful for making shorter plants and plants with modified flowers
  misc_feature: Utility: Useful for making smaller plants
MACINMYNPDGGAAFGGGQPPALGPRISFSSDFVVEPPPPVQNRAMNLRCQEEDINFEFSVGSHPMMAADQLFSKGRILPLKDGGFSSGRPPTTLRDELRCDDRASAKGSSRWKEMLGLRKPLCVGGVNGTAKKSTTVDTEMVTDVADSKQEQ

SEQ ID NO: 2343 - protein, 157 aa, Triticum aestivum
  misc_feature (1)..(157): Public GI no. 51536211
  misc_feature: Utility: Useful for making plants with increased biomass and foliage
  misc_feature: Utility: Useful for making shorter plants and plants with modified flowers
  misc_feature: Utility: Useful for making smaller plants
MACVNMYNPEHHHHQSSSFMAPRISFSSDFALEPPPPAQQQPAVRAPGDADFEFSVGSHPMMAADQLISKGRLLPLREAPHGHGGADAGGRPLTLRDELRTDSRHGRVPRAPNIRWKEFLGLKKAPKKAPTADAAAGATSSSADTQMDLGGQGSTRD

SEQ ID NO: 2344 - protein, 182 aa, Zea mays
  misc_feature (1)..(182): Ceres CLONE ID no. 305610
  misc_feature: Utility: Useful for making plants with increased biomass and foliage
  misc_feature: Utility: Useful for making shorter plants and plants with modified flowers
  misc_feature: Utility: Useful for making smaller plants
MYNPDGAAGFGGGPQQPAALGPRISFSSDFAVEPTPVQNRATSLRCQEEDLNFEFSVGSHPMMAADQLFSKGRILPLKDNGGGSVCFAAARPPTTLRDELRGGGDDDDERAAFSAAGTKGSNSNRWKEMLGLRKALCVGVGGGGNGSPAKKASSSDKQGVVAAAAPGPDDHMAASNQQEQLS

SEQ ID NO: 2345 - protein, 189 aa, Zea mays
  misc_feature (1)..(189): Ceres CLONE ID no. 218076
  misc_feature: Utility: Useful for making plants with increased biomass and foliage
  misc_feature: Utility: Useful for making shorter plants and plants with modified flowers
  misc_feature: Utility: Useful for making smaller plants
  misc_feature (104)..(104): Xaa is any aa, unknown, or other
MACINMYNTDGTAGFGGGPQPPAALGPRVSFSSDFAVEPPPVQNRAMSLRCQEEDVNFEFSVGSHPMMAADQLFSKGRILPLRDNGGCFAAARPPTTLRDELCXGGGVSSDDDERASAAGSKGSGRWKEMLGLRKALCVGNGPPAKKASSGKQGVADDMAASNQGLCYDRADGRDETIIGGTAPQTSHA

SEQ ID NO: 2346 - protein, 160 aa, Zea mays
  misc_feature (1)..(160): Public GI no. 50946783
  misc_feature: Utility: Useful for making plants with increased biomass and foliage
  misc_feature: Utility: Useful for making shorter plants and plants with modified flowers
  misc_feature: Utility: Useful for making smaller plants
MYNPEQQQPPLPHHQLMAPPRMSFSSDFALEPPPPPSGPGRASMGDADFEFSAVGSRPMITADQLFSKGRILPMREVSGGGGGGGRAVTLRDELRGHDGAAVADGRHRRAARPAGSGGGGGVRWKEMLGLKRPGHRKHGAADEGGASTHDLDHMDLGGGE

SEQ ID NO: 2347 - DNA, 623 bp, Arabidopsis thaliana
  misc_feature (1)..(623): Ceres CLONE ID no. 157709
  misc_feature (1)..(623): Also known as  Ceres CDNA ID no. 23361678
atccactcttgattcatggatgatgaaaacttgtggaaagttgtgaagaaagattccatcttcgaaacgactcatttctcttcaaaacctgttttcacacgaagcttctcaacaaaaacttcttcttcttcttcaaaacccgttttcacaagaagtttctcaactaaacccacttcgtattcttcatcagagcccatctttagacggagtttctctgcaaaacccacttcttcgaaatctccgtttctatctagaagcggttccacgaaatgccctgttgatacatcttctacttccaagtgttccatctctcggagcttgtctcagaaaggagcttcggtgacccgaaagtgtcgtaatatggccaaggaacacaagtctcggttttacatcatgaaacgttgcgttctgatgctcgtttgttggcacaaacatgcctgtgattcgtgaagaaagatgcataattaggttatttaattacagattcactctttttttcttatttttttacccatctgttaatttttttccttaagttttctgtattaatgatatactccctccatctcttaaattaaatgtatttttgttttatttatttattttacaaagtgatgttttac

SEQ ID NO: 2348 - protein, 144 aa, Arabidopsis thaliana
  misc_feature (118)..(136): Pfam Name: DVL; Pfam Description: DVL family
  misc_feature: Utility: Useful for making plants with increased biomass and foliage
MDDENLWKVVKKDSIFETTHFSSKPVFTRSFSTKTSSSSSKPVFTRSFSTKPTSYSSSEPIFRRSFSAKPTSSKSPFLSRSGSTKCPVDTSSTSKCSISRSLSQKGASVTRKCRNMAKEHKSRFYIMKRCVLMLVCWHKHACDS

SEQ ID NO: 2349 - protein, 144 aa, Arabidopsis thaliana
  misc_feature (1)..(144): Public GI no. 42822063
  misc_feature: Utility: Useful for making plants with increased biomass and foliage
MDVEKLWNHTKKDSIFQTTHFSSSSKPFFTRSFSTKTSSSPSSKSHFTRSFSTKPSSSSSSSDLIFRRSFSAKPKTSKSLLLSRSCSTKSSADLSSKSSSLSRILSKKGASVTGKCFKVAKEHKSRFYIIKRCVLMLVCWHKHS

SEQ ID NO: 2350 - DNA, 1103 bp, Arabidopsis thaliana
  misc_feature (1)..(1103): Ceres CLONE ID no. 24885
  misc_feature (1)..(1103): Also known as  Ceres CDNA ID no. 23557376
accaccgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaagatgactcagagtcaaaccaacgacggagctggagctggagctgttacgacggtagaatctgttcctcctcagcctcaatctcagcctcagcctcagccgcagcagcagagcaacgagatggttctgcatacgggaagcttgagttttagtagtcatatgtcgagagaagacgaagagatgactcgttctgctctttcggcgtttagagctaaagaagatgagattgagaagaggaggatggaagttcgtgaacggatccaagctcaattgggtcgggtcgaacaagaaaccaaacgtctctctactattcgtgaggagcttgagtctatggcagatcctatgaggaaggaagtttctgtggttcgtaagaagattgatagtgttaacaaagaactcaaacctctaggttccactgttcaaaagaaggaaagggaatacaaagaagcacttgatacattcaacgagaagaacagggagaaagtacagctgatcacaaaactcatggagatggaacagttggttggagaaagcgagaagttgaggatgattaagctggaggagctgagcaagagcatagaaaccgtgtgaaaaaggttgttcaagaagaactaattgggttcttttgtgtgatgtacctacctagtttaaaattttcatcatgtaagatgtgtgggttgcttttttttttattgbtatagtttttttaaagtctttgggggtttgatttgtaaaatttgkgggttctctcttatttttgattaaccaaatttagggatatgggaaaatgggagattcttaggatactgaaactcatcacagtgattattctttctttctctgtattatgttttgtatctgtcttttgaagaatttattatttttttt

SEQ ID NO: 2351 - protein, 195 aa, Arabidopsis thaliana
  misc_feature (30)..(195): Pfam Name: DUF662; Pfam Description: Family of unknown function (DUF662)
  misc_feature: Utility: Useful for making plants with increased biomass and foliage
  misc_feature: Utility: Useful for making smaller plants
MTQSQTNDGAGAGAVTTVESVPPQPQSQPQPQPQQQSNEMVLHTGSLSFSSHMSREDEEMTRSALSAFRAKEDEIEKRRMEVRERIQAQLGRVEQETKRLSTIREELESMADPMRKEVSVVRKKIDSVNKELKPLGSTVQKKEREYKEALDTFNEKNREKVQLITKLMEMEQLVGESEKLRMIKLEELSKSIETV

SEQ ID NO: 2352 - protein, 176 aa, Glycine max
  misc_feature (1)..(176): Ceres CLONE ID no. 693935
  misc_feature: Utility: Useful for making plants with increased biomass and foliage
  misc_feature: Utility: Useful for making smaller plants
MATPKQSYEQQQQQQQPNVQRVRNSGMINSNQSPMRDDKEEEMSRSALAMFRAKEEEIERRKVEVRDKVHAYLGRVEEETKRLAEIREELEGLTDPLRKEVAIVRKKIDSVNKELKPLGQTCQRKEREYKEALDAFNEKNKEKAQLVTKLMELVTESEKLRMKKLEELSKNVDTLH

SEQ ID NO: 2353 - protein, 157 aa, Zea mays
  misc_feature (1)..(157): Ceres CLONE ID no. 359934
  misc_feature: Utility: Useful for making plants with increased biomass and foliage
  misc_feature: Utility: Useful for making smaller plants
MQIVCVRSASTGGGEEVGEWAEQSSRSALSLFKEKEEEIERKKVEVRDKVFSMLGRVEEETKRLAFIRQELELMADPTRREVDAIRKRIDKVNRQLKPLGKTCLKKEKEYKMCLEAYNEKNNEKATLVNRLLELVSESERLRMKKLEELNKTIESLY

SEQ ID NO: 2354 - protein, 170 aa, Zea mays
  misc_feature (1)..(170): Ceres CLONE ID no. 294598
  misc_feature: Utility: Useful for making plants with increased biomass and foliage
  misc_feature: Utility: Useful for making smaller plants
MQGGGGVDQPPMQMVLRVRHPSSLGGSGADEDDGEGSSRSALSVFKAKEEQIERRKMEVREKVFAHLGRVEEESKRLAFIRQELEGMADPTRKEVESIRKRIDTVNRQLKPLSKSCVKKEKEYKEVLEAYNEKSKEKALLVNRLIELVSESERMRMKKLEELNKTVDSLY

SEQ ID NO: 2355 - protein, 159 aa, Triticum aestivum
  misc_feature (1)..(159): Ceres CLONE ID no. 839270
  misc_feature: Utility: Useful for making plants with increased biomass and foliage
  misc_feature: Utility: Useful for making smaller plants
  misc_feature (101)..(101): Xaa is any aa, unknown, or other
  misc_feature (104)..(104): Xaa is any aa, unknown, or other
  misc_feature (105)..(105): Xaa is any aa, unknown, or other
  misc_feature (112)..(112): Xaa is any aa, unknown, or other
  misc_feature (116)..(116): Xaa is any aa, unknown, or other
  misc_feature (118)..(118): Xaa is any aa, unknown, or other
  misc_feature (141)..(141): Xaa is any aa, unknown, or other
  misc_feature (145)..(145): Xaa is any aa, unknown, or other
  misc_feature (154)..(154): Xaa is any aa, unknown, or other
  misc_feature (157)..(157): Xaa is any aa, unknown, or other
  misc_feature (159)..(159): Xaa is any aa, unknown, or other
MQMVLRVKHPSSLSSGSEEASEGEGSSRSALSVFKAKEEQIERKKMEVRDKVFAQLGRVEEESKRLAFIRQELEGMADPTRKEVESIQRRIDTVNRQLKPXSKXXVKKEKEXKEIXEXYNEKSKEKAILVNRLIELVSESXRMRXKKLEELNKXVDXLX

SEQ ID NO: 2356 - DNA, 1012 bp, Arabidopsis thaliana
  misc_feature (1)..(1012): Ceres CLONE ID no. 27810
  misc_feature (1)..(1012): Also known as  Ceres CDNA ID no. 23357720
acaaattgaatttgagaatattaaacgaaaaaacgtttttgcttgagagagaggcgaatctgattcttgtgagagcttccaacaaagtctgcaggctcatcctgcggatcccttcccaatttctcttaggcaggtatcccttcattggcgagatccttgttttcttcgttggggaacagattgcccaaactgaagtctctctctctctgttatggctaaacagagaccggcgacgttgtcagtctacctctacattcccaatatcgttgggtacatgagagttctcttgaactgcattgccttctctgtgtgcttctccaacaagacactcttctccctcttgtactttttcagtttttgttgtgatgctgtggatggatggtgcgctcgtaaatttaaccaagtctctacatttggagctgttttggatatggttacagatagagtcagcacagcctgtcttctcgtgattctctcccagatatacaggcctagcttggttttcctgtcattgctggctttagatatcgctagtcactggctgcaaatgtacagtaccttcctatcagggaagaccagccataaggatgtgaaagatagcacgagctggctctttagactctattatggaaaccggatgttcatgggttattgctgtgtttcctgcgaggttctttatataatccttcttctcatagcaacgaaccaaaccgaaaacttgatgaacgtggtagtgaaatcattgatgcagatttcaccgctctctttactcttggctttgagcatatttggttggtccatcaagcagatcatcaatgtgattcagatgaaaacggctgcagatgtttgtgtcctgtatgacatagagaaacagcataagaagccttgacgttatgtgcccgtgaatcgtgtttaactcttttgtttcatgttgtgtacgacactgtacatacggatccatcttgtttagtatgtagataaactcttgtctttaaatccattcactattttc

SEQ ID NO: 2357 - protein, 225 aa, Arabidopsis thaliana; identical to SEQ ID NO: 2120
  misc_feature (42)..(209): Pfam Name: CDP-OH_P_transf; Pfam Description: CDP-alcohol phosphatidyltransferase
  misc_feature: Utility: Useful for making smaller plants

SEQ ID NO: 2358 - protein, 227 aa, Arabidopsis thaliana; identical to SEQ ID NO: 2119
  misc_feature (1)..(227): Public GI no. 21745398
  misc_feature: Utility: Useful for making smaller plants

SEQ ID NO: 2359 - protein, 227 aa, Arabidopsis thaliana
  misc_feature (1)..(227): Public GI no. 22655196
  misc_feature: Utility: Useful for making smaller plants
MAKKERPRPEKLSVYLYIPNIVGYMRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDIEKQQKP

SEQ ID NO: 2360 - protein, 203 aa, Arabidopsis thaliana
  misc_feature (1)..(203): Ceres CLONE ID no. 34210
  misc_feature: Utility: Useful for making smaller plants
MRVLLNCVAFAVCFSNKPLFSVLYFFSFCCDAVDGWVARRFNQVSTFGAVLDMVTDRVSTACLLVILSQIYRPSLVFLSLLALDIASHWLQMYSTFLAGKSSHKDVKDSTSWLFRLYYGNRIFMCYCCVSCEVLYIILLLIAKNQSENLLNVVVATLTQISPLSFLLALTLFGWSMKQTINVIQMKTAADVCVLYDLEKQQKP

SEQ ID NO: 2361 - protein, 227 aa, Arabidopsis thaliana; identical to SEQ ID NO: 2118
  misc_feature (1)..(227): Public GI no. 21592927
  misc_feature: Utility: Useful for making smaller plants

SEQ ID NO: 2362 - protein, 227 aa, Glycine max; identical to SEQ ID NO: 2123
  misc_feature (1)..(227): Ceres CLONE ID no. 581207
  misc_feature: Utility: Useful for making smaller plants

SEQ ID NO: 2363 - protein, 223 aa, Glycine max; identical to SEQ ID NO: 2128
  misc_feature (1)..(223): Public GI no. 50904897
  misc_feature: Utility: Useful for making smaller plants

SEQ ID NO: 2364 - protein, 223 aa, Glycine max; identical to SEQ ID NO: 2129
  misc_feature (1)..(223): Public GI no. 13661020
  misc_feature: Utility: Useful for making smaller plants

SEQ ID NO: 2365 - protein, 215 aa, Glycine max; identical to SEQ ID NO: 2127
  misc_feature (1)..(215): Public GI no. 34577127
  misc_feature: Utility: Useful for making smaller plants

SEQ ID NO: 2366 - protein, 149 aa, Zea mays
  misc_feature (1)..(149): Ceres CLONE ID no. 284101
  misc_feature: Utility: Useful for making smaller plants
MVTDRVSTACLLALLSQFYRPGLVFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 2367 - protein, 149 aa, Zea mays; identical to SEQ ID NO: 2366
  misc_feature (1)..(149): Ceres CLONE ID no. 259619
  misc_feature: Utility: Useful for making smaller plants

SEQ ID NO: 2368 - protein, 152 aa, Zea mays
  misc_feature (1)..(152): Ceres CLONE ID no. 306792
  misc_feature: Utility: Useful for making smaller plants
MVTDRVSTACLLALLSQFYRPGLVFLILLGLDITSHWFQMYSSFLSGKTSHKDVKHTGNWLLKLYYGYRPFMAFCCVSCEVLYIILFLFADEKSTSLLSACKGLLNQSPIIILVFISTLVGWAVKQVTNVIQMKTAADACVVYDLKRSKRKA

SEQ ID NO: 2369 - protein, 152 aa, Zea mays; identical to SEQ ID NO: 2368
  misc_feature (1)..(152): Ceres CLONE ID no. 321760
  misc_feature: Utility: Useful for making smaller plants

SEQ ID NO: 2370 - DNA, 690 bp, Arabidopsis thaliana
  misc_feature (1)..(690): Ceres CLONE ID no. 40708
  misc_feature (1)..(690): Also known as  Ceres CDNA ID no. 23382144
cctaatcgaaaagtctcgtctctctctctctctctttgtctccgccatgacaagctcttcatctcctgcacgcaaggcgttaagcaagatcgcgtgtaataggttacaaaaggagttatcagagtggcaagtaaatccaccgactgggtttaagcacagagttactgataatctccaaaaatgggtaattgaggtaacaggagcacctggtacgctttacgctaatgaaacttataatcttcaggttgagtttcctcaacattatcctatggaagctcctcaggtgatttttgttccaccagctccgttacatcctcatatttacagcaatggacatatttgtttagatattctgtatgactcatggtctccagcaatgacagtgagttcagtctgtatcagcattctctcgatgctatcaagttcacccgaaaagcaacgccccactgataatgatcgatatgtgaagaactgcaagaacgggaggtctcctaaagagacaaggtggtggttccatgacgacaaggtttaatgatgacgaccttaagatgtctctcctttcagttacaaaagaggtttatataatttcccaagactgataatactaattgaaattcctcatggcctcccacttttttttctgtaacggatcattatgtataaatgacatctgaaatgtttcagtgtctg

SEQ ID NO: 2371 - protein, 161 aa, Arabidopsis thaliana
  misc_feature (19)..(158): Pfam Name: UQ_con; Pfam Description: Ubiquitin-conjugating enzyme
  misc_feature: Utility: Useful for making smaller plants
  misc_feature: Utility: Useful for modifying plant structure, ie increased branching
MTSSSSPARKALSKIACNRLQKELSEWQVNPPTGFKHRVTDNLQKWVIEVTGAPGTLYANETYNLQVEFPQHYPMEAPQVIFVPPAPLHPHIYSNGHICLDILYDSWSPAMTVSSVCISILSMLSSSPEKQRPTDNDRYVKNCKNGRSPKETRWWFHDDKV

SEQ ID NO: 2372 - protein, 161 aa, Glycine max
  misc_feature (1)..(161): Ceres CLONE ID no. 670593
  misc_feature: Utility: Useful for making smaller plants
  misc_feature: Utility: Useful for modifying plant structure, ie increased branching
MTSSSAAARKNLSKIACNRLQKELVEWQVNPPTGFKHKVTDNLQRWVVEVTGAPGTLYANETYQLQVDFPENYPMEAPQVIFLHPAPLHPHIYSNGHICLDILYDSWSPAMTVSSICISILSMLSSSTTKQRPEDNDRYVKNCRNGRSPKETRWWFHDDKV

SEQ ID NO: 2373 - protein, 161 aa, Zea mays
  misc_feature (1)..(161): Ceres CLONE ID no. 387067
  misc_feature: Utility: Useful for making smaller plants
  misc_feature: Utility: Useful for modifying plant structure, ie increased branching
MTSSSSPSRKALSKIACNRLQKELAEWQLSPPAGFKHKVSDNLQRWVIEVTGAAGTLYAGETYKLQVDFPEHYPMEAPQVIFLHPAPMHPHIYSNGHICLDILYDSWSPAMTVSSICISILSMLSSSPEKQRPADNDRYVKNCRNGRSPKETRWWFHDDTV

SEQ ID NO: 2374 - protein, 161 aa, Arabidopsis thaliana
  misc_feature (1)..(161): Ceres CLONE ID no. 27375
  misc_feature: Utility: Useful for making smaller plants
  misc_feature: Utility: Useful for modifying plant structure, ie increased branching
MSSSGAPSRKTLSKIATNRLQKELVEWQMNPPTGFKHKVTDNLQRWIIEVIGAPGTLYANDTYQLQVDFPEHYPMESPQVIFLHPAPLHPHIYSNGHICLDILYDSWSPAMTVSSICISILSMLSSSTEKQRPTDNDRYVKNCKNGRSPKETRWWFHDDKV

SEQ ID NO: 2375 - protein, 161 aa, Zea mays
  misc_feature (1)..(161): Ceres CLONE ID no. 280334
  misc_feature: Utility: Useful for making smaller plants
  misc_feature: Utility: Useful for modifying plant structure, ie increased branching
MTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPVDNDRYVRNCRNGRSPKETRWWFHDDTV

SEQ ID NO: 2376 - protein, 156 aa, Brassica napus
  misc_feature (1)..(156): Ceres CLONE ID no. 1256091
  misc_feature: Utility: Useful for making smaller plants
  misc_feature: Utility: Useful for modifying plant structure, ie increased branching
  misc_feature (3)..(3): Xaa is any aa, unknown, or other
  misc_feature (4)..(4): Xaa is any aa, unknown, or other
  misc_feature (5)..(5): Xaa is any aa, unknown, or other
  misc_feature (92)..(92): Xaa is any aa, unknown, or other
  misc_feature (112)..(112): Xaa is any aa, unknown, or other
MRXXXRKIACNRLQKELTEWQLNPPTGFRHKVTDNLQKWTIDVTGAPGTLYANETYQLQVEFPVNYPMEAPQVIFVPPAPSHPHIYSNGHIXLDILYDSWSPAMTVSSVCIXILSMLSSSPAKERPADNDRYVKNCKNGRSPKGDEVVASMTTRLD

SEQ ID NO: 2377 - protein, 161 aa, Triticum aestivum
  misc_feature (1)..(161): Ceres CLONE ID no. 677474
  misc_feature: Utility: Useful for making smaller plants
  misc_feature: Utility: Useful for modifying plant structure, ie increased branching
MTSSSTPSRKALSKIACNRLQKELAEWQVGPPAGFKYKVSDNLQRWVIEVGGAEGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDKV

SEQ ID NO: 2378 - protein, 163 aa, Triticum aestivum
  misc_feature (1)..(163): Ceres CLONE ID no. 618269
  misc_feature: Utility: Useful for making smaller plants
  misc_feature: Utility: Useful for modifying plant structure, ie increased branching
MTSSASSSPSRKVLSKIACLRLQKELGEWQASPPGGFTYKVSDNLQRWVIEVSGAEGTLYAGETYRLQVDFPEQYPMEAPQVIFMHPAPMHPHIYSNGHICLDILYDSWSPAMTVSSVCISILSMLSSSPAKERPSDNDRYVRNCRNGRSPKETRWWFHDDKV

SEQ ID NO: 2379 - protein, 137 aa, Arabidopsis thaliana
  misc_feature (1)..(137): Ceres CLONE ID no. 40968
  misc_feature: Utility: Useful for making smaller plants
  misc_feature: Utility: Useful for modifying plant structure, ie increased branching
MEWQTNPPSGFKHRVSDNLQRWIIEVHGVPGTLYANETYQLQVEFPEHYPMEAPQVIFQHPAPLHPHIYSNGHICLDVLYDSWSPAMRLSSICLSILSMLSSSSVKQKPKDNDHYLKNCKHGRSPKETRWRFHDDKV

SEQ ID NO: 2380 - protein, 159 aa, Arabidopsis thaliana
  misc_feature (1)..(159): Ceres CLONE ID no. 113577
  misc_feature: Utility: Useful for making smaller plants
  misc_feature: Utility: Useful for modifying plant structure, ie increased branching
MSSSGAPSRKTLSKIATNRLQKELVEWQMNPPTGFKHKVTDNLQRWIIEVIGAPGTLYANDTYQLQVDFPEHYPMESPQVIFLHPAPLHPHIYSNGHICLDILYDSWSPAMTVSSICISILSITAGSTRGKDLIGWRITRCSRIHRRWMKEILITTRNR

SEQ ID NO: 2381 - DNA, 1504 bp, Arabidopsis thaliana
  misc_feature (1)..(1504): Ceres CLONE ID no. 116117
  misc_feature (1)..(1504): Also known as  Ceres CDNA ID no. 23363771
atcttcgcttgcttcctcctcaaaaggtgaaaaattagagcgagagagatagagagagatttcaaaacgaaaatccagagaaagggtcttgccagtttagggcatccttgtgggtgagagagcgattgagagatttcaaaaggaggaagaggaagatacgagtgtgagagagatttagagggagagaagaaagagagattctttttgagtgtgttagggtttcatttcctctgcagatctacatttatctcttctcatggaacggaagcttgtggttttgggaatcccgtgggatattgattccgatgggcttaaggattacatgtcaaaatttggagacttggaggattgtattgtcatgaaggatcgatcaactggaagatctcgtggatttggatatgtcacttttgcttcagccgaagatgcaaagaatgctttgaaaggtgaacactttttagggaacaggatcttggaagttaaagtggctacaccaaaggaagagatgagacagcctgcaaaaaaagtgacgaggatcttcgttgctcgaatcccttcatcagtctctgaatcagatttccgaagccattttgagaggtatggggaaataacagacttatacatgcctaaggactacaactcgaagcagcaccgacgaatagggtttatcacattctctagtgctgattcagtggaggatctgatggaggacactcatgatctgggaggtacaacagttgctgttgatcgggcaacaccaaaagaggatgatcatccgcctaggccaccgccagtggctagaatgtcgcgcccacccgtggctattgcaggtggatttggagctccaggtggttatggagcttatgatgcttacatttctgcagctacaagatacgcagcgcttggtgcccctactttgtatgataatcccgccacgttttatggaagaggggaaccaaccacaaggggaataggaaacaagatctttgttggacggcttcctcaagaagcatccgttgatgatcttcgcgattattttgggagatttggccatattcaagatgcttatattccaaaggacccaaagagaagtggacatagaggttttggatttgttacctttgctgaaaatggtgttgcagatcgtgtagcccgaagatctcatgaaatctgtggacaagaggtagcaatagattcagcaacgcctcttgatgaagctggacctagcgctggcgcaagttccatgttaagttcttctcgtcctgaatattttggtggctatggaggtcctatgcgcgcatttggtcgaatgtatggaggcatgagcttggacgattggggatatggaatgccaaacgcaagaccatcaagaccagaccggaggtaccggccatactaatgcagcagaccaacatttcattagctttggctttgtctttttatagaaacttcactttgtcagatctattttaattgaagcttttgtttatgttttaccctcggaacc

SEQ ID NO: 2382 - protein, 379 aa, Arabidopsis thaliana
  misc_feature (5)..(74): Pfam Name: RRM_1; Pfam Description: RNA recognition motif. (a.k.a. RRM, RBD, or RNP domain)
  misc_feature: Utility: Useful for making smaller plants
MERKLVVLGIPWDIDSDGLKDYMSKFGDLEDCIVMKDRSTGRSRGFGYVTFASAEDAKNALKGEHFLGNRILEVKVATPKEEMRQPAKKVTRIFVARIPSSVSESDFRSHFERYGEITDLYMPKDYNSKQHRRIGFITFSSADSVEDLMEDTHDLGGTTVAVDRATPKEDDHPPRPPPVARMSRPPVAIAGGFGAPGGYGAYDAYISAATRYAALGAPTLYDNPATFYGRGEPTTRGIGNKIFVGRLPQEASVDDLRDYFGRFGHIQDAYIPKDPKRSGHRGFGFVTFAENGVADRVARRSHEICGQEVAIDSATPLDEAGPSAGASSMLSSSRPEYFGGYGGPMRAFGRMYGGMSLDDWGYGMPNARPSRPDRRYRPY

SEQ ID NO: 2383 - protein, 339 aa, Glycine max
  misc_feature (1)..(339): Ceres CLONE ID no. 467735
  misc_feature: Utility: Useful for making smaller plants
MSKFGELEDCIVMKERSTGRSRGFGYVTFASVDDAKEVLSSEHILGNRTLEVKVATPKEEMRAPVKKVTRIFVARIPQSVTEATFRSHFEKYGEITDLYMPKDQGSKMHRGIGFITFASADSVENLMSETHELGGSAVVVDRATPKDDDFKPIGRMPLPPPTQGGYGAYNAYISAATRYAALGAPTLYDQPGPIYGRGDPSRRTSKKIFVGRLPPEATSDDLRQYFGRFGRILDVYVPRDPKRTGHRGFGFVTFAEDGVADRVSRRSHEICGHQVAIDSATPVDDAGPSGNFMMNSMESFGGYGGPVRSYGRMYGSLDFDDWGYGIGRPSRADWRYRPY

SEQ ID NO: 2384 - protein, 358 aa, Zea mays
  misc_feature (1)..(358): Ceres CLONE ID no. 333643
  misc_feature: Utility: Useful for making smaller plants
MKLVVLGIPWDVDTEGLREYMAKFGPLDDCVVMKERSSGRSRGFGYVTFASADDAKNVLDCEHVLGSRTLEVKVATPKEEMKSQGSKKATRIFVARIPQSVDESMFRRHFEAFGEILDLYMPKEHGSKGHRGIGFITFQSAESVDNIMQESHELDGTTVVVDRATPKDEDVRYPPSRPSQGGYGAYNAYISAATRYATLGAPTLYDHPGSAYGRGYYGPSQAVGKKIFVGRLPQEANTDDLRQYFGRFGRIVDAYIPKDPKRSGHRGFGFVTFADDGVAERVARRSHEILGHEVAIDTAAPLENDSAAGGYIDPMDLYGAYGSMRSFGRFCGGLDYNYGYGPSSGSSRSRSDWRYRPY

SEQ ID NO: 2385 - protein, 363 aa, Zea mays
  misc_feature (1)..(363): Public GI no. 57899379
  misc_feature: Utility: Useful for making smaller plants
MATKLVVLGIPWDVDTEGLREYMGKFGPLDDCVVMKERSSGRSRGFGYVTFSSADDAKNVLECEHVLGNRTLEVKIATPKEEMKSQGSKKATRIFVARIPQSVDESMFRRHFEAYGEITDLYMPKEHGSKGHRGIGFITFQSAESVDSIMQDSHELDGTTVVVDRATPKDEEVRYPPSRGASQGGYGAYNAYISAATRYAALGAPTLYDHPGSAYGRGGYYGSSQGMGNKKIFVGRLPQEANTEDLRHYFGKFGRIVDAYIPKDPKRSGHRGFGFVTFADEGVADRVARRSHEILGHEVAIDTAAPLEGDSGGGYMEPMDLYGAYGSMRTYGRFCSGIDYDYGYGHSGSSSSRSRADWRYRPY

SEQ ID NO: 2386 - DNA, 1334 bp, Glycine max
  misc_feature (1)..(1334): Ceres CLONE ID no. 538933
  misc_feature (1)..(1334): Also known as  Ceres CDNA ID no. 23694939
tcttctaaccagtatcacctacacggtgtgtgtgtcccttcatcctggaaattagagccacaaacataacacattccgctttgactttggaggcaggtttttgtgctttgtctggttcccaatcaccgtgatatcatggaatccccacaatctgttgtgtcaccattcaagaggtctgtcttgggtgatgcagagaagtataggtctgatgttctgtctaaggacattgaagtcaatggaaaggaaggtgccgtgtgtaatgtggaggaattcattggtgttgttgatgtttacattcatcaggccagggacattcataacatctgcatataccacaagcaagatgtttatgctaagatttgtttgactagtaatcctgagaatactgtctctaccaagaccatcaatggaggaggaaggaaccccgtgtttaatgagaatcttagtctaagcgttaggactgttgattctgtagtcaaatgtgaaatttggatgctgagcagggtgaagaattatcttgaagatcagttgcttggttttgctttggtgcctttgtctgaagtactggtgaagaaggatggcaaactagagaaagagttctctctttcttcaactgatctattccattctccagccggttatgttcaattgtctcttgcttacactggtgcttcgcctgatgttatggcaatttcttcaatgcctaccaccgagaaggactccgaatcatgcgagtcactggtcagagatttggacaaaatcgaattcccggatccaaaaattgtaaatgaagaccacttgatggtttcggaatacttcggcattccatgtgaggagagccagtgttctgatagcttgaccactactgatactgaaaatcttagttctgaagcaggtgttcagcttgtggagagcttctcagcatgcagtgttagcagtgtgtcaacaaatggggtttcatctccttcagtggctgcaagctcagactcgtctcccaatgaggaaaccaaagagaaaaatgtggatgtcaaagatggtgagactgattcctcgttccctaaacctcttgtgactgttaacatcgagccggagccgaatgtggtgcagcaggattttgtagacatgtacatgaaaagcatgcagcaattcaccgagtcattggcaaaaatgaagcttcctgtggactttgaaagtggaccaactagttcaggaaactctagctctgaacacaagctacagacaccaaagagcactaactcccgtgtgttttatggcagcagggctttcttctgaactttttgatcaagggaatactttcaggtgacttagatttt

SEQ ID NO: 2387 - protein, 385 aa, Glycine max
  misc_feature (50)..(137): Pfam Name: C2; Pfam Description: C2 domain
  misc_feature: Utility: Useful for making smaller plants
MESPQSVVSPFKRSVLGDAEKYRSDVLSKDIEVNGKEGAVCNVEEFIGVVDVYIHQARDIHNICIYHKQDVYAKICLTSNPENTVSTKTINGGGRNPVFNENLSLSVRTVDSVVKCEIWMLSRVKNYLEDQLLGFALVPLSEVLVKKDGKLEKEFSLSSTDLFHSPAGYVQLSLAYTGASPDVMAISSMPTTEKDSESCESLVRDLDKIEFPDPKIVNEDHLMVSEYFGIPCEESQCSDSLTTTDTENLSSEAGVQLVESFSACSVSSVSTNGVSSPSVAASSDSSPNEETKEKNVDVKDGETDSSFPKPLVTVNIEPEPNVVQQDFVDMYMKSMQQFTESLAKMKLPVDFESGPTSSGNSSSEHKLQTPKSTNSRVFYGSRAFF

SEQ ID NO: 2388 - protein, 384 aa, Glycine max
  misc_feature (1)..(384): Ceres CLONE ID no. 470921
  misc_feature: Utility: Useful for making smaller plants
MSNVEEFLGVLDVYIHQARDIQNICIYHKQDVYAKISLTSNPETTMSTKTINGGGRNPVFNENLRIDVRTVDASLKCEIWMLSRVKNYLEDQLLGFALVPLSEVLVQNGKLEKEFSLSSTDLFHSPSGFVQLSLSYTGASPDVMAISAMPNKVATDGTVQDSDTSESLARDLDKIEFPDPKIVNEDHLMVSEYFGIRCEETQCSDSLATSDAENHSSEAGVQLVESFSACSVESVQPTKVDSPPSSVSTNGVSSPSVPANSESSDAAAAASKSPIQEQVSGTKEDKNVDAKDGESDSSCGVPIDSFPKPVVSVNIEPEPKVVQQDIVDMYMKSMQQFTESLAKMKLPMDLESEPTSSGNSTTEQKLQPSKSNNSRVFYGSRAFF

SEQ ID NO: 2389 - protein, 212 aa, Arabidopsis thaliana
  misc_feature (1)..(212): Ceres CLONE ID no. 1367041
  misc_feature: Utility: Useful for making smaller plants
MDSPQSVVSPFKIGESENENSNSVQSSGNQSNGINSNGKDSKSCGRQDLVGALEVYVHQARDIHNICIYHKQDVYAKLCLTSDPDKSVSTKIINGGGRNPVFDDNVKLDVRVLDTSLKCEIYMMSRVKNYLEDQLLGFTLVPMSELLFKNGKLEKEFSLSSTDLYHSPAGFVQLSLSYYGSYPDVMAIPSMPSSVSIDETTKDPEGSESVSG

SEQ ID NO: 2390 - protein, 112 aa, Zea mays
  misc_feature (1)..(112): Ceres CLONE ID no. 1557119
  misc_feature: Utility: Useful for making smaller plants
MAATYQTGLVAEPQLLNTEIITRRATNCVADTNRKDKCVGYLDVFVHQARDIHNVCIYHKQDVYAKLCLTSSPDVSCSTKVINSAGRNPVFEESLRLDVQTVDALSSARYGC

SEQ ID NO: 2391 - protein, 77 aa, Triticum aestivum
  misc_feature (1)..(77): Ceres CLONE ID no. 763949
  misc_feature: Utility: Useful for making smaller plants
MESQQKQQMEAVSAPAATNGGGELIGYVDVHVRSARDIQNICIYHKQDVYARLSLPGEGAPAASTQVINGGGRNPVF

SEQ ID NO: 2392 - protein, 283 aa, Arabidopsis thaliana
  misc_feature (1)..(283): Ceres CLONE ID no. 113269
  misc_feature: Utility: Useful for making smaller plants
MMSRVKNYLEDQLLGFTLVPMSELLFKNGKLEKEFSLSSTDLYHSPAGFVQLSLSYYGSYPDVMAIPSMPSSVSIDETTKDPEGSESVPGELDKIEFPDPNVANENEKMVSEYFGISCSTIDSETSDSLVTSDAENHVTNSVTSILKQDSPESSNATNGAASPHASAHSATETPNHEHLSVVNSKASSQESESEASGETSEEKTVKSVLTVKVEPESKVVQQDIVDMYMKSMQQFTDSLAKMKLPLDIDSPTKSENSSSDSQKLPTPKSNNGSRVFYGSRPFF

SEQ ID NO: 2393 - protein, 359 aa, Arabidopsis thaliana
  misc_feature (1)..(359): Ceres CLONE ID no. 115393
  misc_feature: Utility: Useful for making smaller plants
MSSDSDSFIGVLEVFVHQARDIHNICIYHKQDVYAKLCLTNDPENSLSTKIINGGGQNPVFDDTLQFDVKNLDCSLKCEIFMMSRVKNYLEDQLLGFSLVPLSEVIVRNGKLEKEFSLSSTDLYHSPAGFVELSLSYAGDSPDVMHIPAVPTADETELAPIEFDESEFLDPKIVCENNQMVSKYFSTTCSDSDDFASSETGFVEVNSILSAVVETAVDEAAPANTVSTNGISSPSTAVSSGSSGTHDVSKQSSEGNNSDSEQEAKKPTDIIKSGDLDKTDEEAVVKPVLTVHIEPEQKVVQQDIVDMYTKSLQQFTESLAKMKLPLDIDSPTQSENSSSSQQTPKSASSRVFYGSRAFF

SEQ ID NO: 2394 - protein, 262 aa, Zea mays
  misc_feature (1)..(262): Ceres CLONE ID no. 452749
  misc_feature: Utility: Useful for making smaller plants
MAATYQTGLVAEPQLLNTEIITRRATNSVADTNRKDKCVGYLDVFVHQARDIHNVCIYHKQDVYAKLCLTSSPDVSCSTKVINSAGRNPVFEESLRLDVQTVDASLKCEIWMLSRVRNYLEDQLLGFALVPLVDILIGNGKLVQEFSLTSTDLFHTPAGFVHLSLSYAGCSPDVVLISSPNNSPSTVYDSGIDHVVPSQLEKIVFPDLNVEKEDEIMVSKYLEMTSDSETPIKVENGVSLHSANDDDVPSKLEKIKFIDSES

SEQ ID NO: 2395 - protein, 278 aa, Arabidopsis thaliana
  misc_feature (1)..(278): Ceres CLONE ID no. 39481
  misc_feature: Utility: Useful for making smaller plants
MMSRVKNYLEDQLLGFSLVPLSEVIVRNGKLEKEFSLSSTDLYHSPAGFVELSLSYAGDSPDVMHIPAVPTADETELAPIEFDESEFLDPKIVCENNQMVSKYFSTTCSDSDDFASSETGFVEVNSILSAVVETAVDEAAPANTVSTNGISSPSTAVSSGSSRTHDVSKQSSEGNNSDSEQEAKKPTDIIKSGDLDKTDEEAVVKPVLTVHIEPEQKVVQQDIVDMYTKSLQQFTESLAKMKLPLDIDSPTQSENSSSSQQTPKSASSRVFYGSRAFF

SEQ ID NO: 2396 - protein, 432 aa, Triticum aestivum
  misc_feature (1)..(432): Ceres CLONE ID no. 677448
  misc_feature: Utility: Useful for making smaller plants
MEAVSAPAASTNGGGELIGYVDVHVRSARDIQNICIYHKQDVYARLSLPGEGAPAASTQVINGGGRNPVFDQSVRVGVRAGDVDAALRCEVWMLSRVKNYLQDQLLGFALVPLPDVVAAEGGTLAREFPLSTNDLFHSPAGFLELELSYIGVVPDVIPVSPTPKPALADPDECENAGGGAGAGAGKDYENMEFPDMNLVEENQIMLSEYVGLPCTAMETQSSESLLTSEDVDGAATESHDAGVRVVQSFSTDYSTADSAGAFRSETAASSVSTTESPAAAVPATPQSNPSEPSGNALSSAGQKEKASDAAEVDSSPTVQESPAVNSPSTVSENAVDKPPPAMSFNFAEEVQVNQKEIMDMYMKSMQQFTESLAKMKLPLDMDNGSDKSGSGPAAASPTDSSGTDSSAATKKPTAGAAQEKSPKVFYGSRAFF

SEQ ID NO: 2397 - DNA, 557 bp, Arabidopsis thaliana
  misc_feature (1)..(557): Ceres CLONE ID no. 519
  misc_feature (1)..(557): Also known as  Ceres CDNA ID no. 23364910
atactatcaacttttctctatctatctctctctcttctttttccggcataacttctgtgttaccctaaactccataacctgtttcatcgataaagtgcctttgcttctatctctgtcactcttactacttgttgaacaatattctacaaaaaaatgtcgggaagaagatcacgttcgaggcaatcatcaggaacttcaaggatctcagaagatcaaatcaatgatctgattatcaagttgcaacagcttcttcctgagctcagggacagtcgtcgttccgacaaggtttcagcagcgagggtgttacaagatacgtgcaactacatacggaatctgcatagagaggttgatgatctaagtgagaggctatctgagttactagcaaactcagacactgcacaagctgctttaatcagaagcttacttacccaataattcctatctatctttttcttcttcttcttttttttgtttactataataataataatagtttgcgggtttttttttctatagatgttgatgaccttataaacgtttaatgatacgagttcgtc

SEQ ID NO: 2398 - protein, 93 aa, Arabidopsis thaliana
  misc_feature (20)..(62): Pfam Name: HLH; Pfam Description: Helix-loop-helix DNA-binding domain
  misc_feature: Utility: Useful for making smaller plants
  misc_feature: Utility: Useful for making taller plants
MSGRRSRSRQSSGTSRISEDQINDLIIKLQQLLPELRDSRRSDKVSAARVLQDTCNYIRNLHREVDDLSERLSELLANSDTAQAALIRSLLTQ

SEQ ID NO: 2399 - protein, 90 aa, Glycine max; identical to SEQ ID NO: 1923
  misc_feature (1)..(90): Ceres CLONE ID no. 1247092
  misc_feature: Utility: Useful for making smaller plants
  misc_feature: Utility: Useful for making taller plants

SEQ ID NO: 2400 - protein, 94 aa, Glycine max; identical to SEQ ID NO: 1921
  misc_feature (1)..(94): Public GI no. 28416803
  misc_feature: Utility: Useful for making smaller plants
  misc_feature: Utility: Useful for making taller plants

SEQ ID NO: 2401 - protein, 94 aa, Arabidopsis thaliana; identical to SEQ ID NO: 1922
  misc_feature (1)..(94): Ceres CLONE ID no. 18200
  misc_feature: Utility: Useful for making smaller plants
  misc_feature: Utility: Useful for making taller plants

SEQ ID NO: 2402 - protein, 92 aa, Glycine max; identical to SEQ ID NO: 1919
  misc_feature (1)..(92): Ceres CLONE ID no. 653656
  misc_feature: Utility: Useful for making smaller plants
  misc_feature: Utility: Useful for making taller plants

SEQ ID NO: 2403 - protein, 92 aa, Glycine max; identical to SEQ ID NO: 1920
  misc_feature (1)..(92): Ceres CLONE ID no. 663844
  misc_feature: Utility: Useful for making smaller plants
  misc_feature: Utility: Useful for making taller plants

SEQ ID NO: 2404 - protein, 92 aa, Triticum aestivum; identical to SEQ ID NO: 1918
  misc_feature (1)..(92): Ceres CLONE ID no. 733804
  misc_feature: Utility: Useful for making smaller plants
  misc_feature: Utility: Useful for making taller plants

SEQ ID NO: 2405 - protein, 91 aa, Triticum aestivum; identical to SEQ ID NO: 1899
  misc_feature (1)..(91): Ceres CLONE ID no. 703180
  misc_feature: Utility: Useful for making smaller plants
  misc_feature: Utility: Useful for making taller plants

SEQ ID NO: 2406 - protein, 91 aa, Glycine max; identical to SEQ ID NO: 1899
  misc_feature (1)..(91): Ceres CLONE ID no. 560681
  misc_feature: Utility: Useful for making smaller plants
  misc_feature: Utility: Useful for making taller plants

SEQ ID NO: 2407 - protein, 91 aa, Glycine max; identical to SEQ ID NO: 1899
  misc_feature (1)..(91): Ceres CLONE ID no. 562428
  misc_feature: Utility: Useful for making smaller plants
  misc_feature: Utility: Useful for making taller plants

SEQ ID NO: 2408 - protein, 92 aa, Glycine max
  misc_feature (1)..(92): Ceres CLONE ID no. 560948
  misc_feature: Utility: Useful for making smaller plants
  misc_feature: Utility: Useful for making taller plants
MSSRRSRQHSGSTRISDDQIIELVSKLRQLVPEIRNRRSDKVSASKVLQETCNYIRGLHREVSDLSERLSQLLTTIDADSAEAGIIRSLLNQ

SEQ ID NO: 2409 - protein, 92 aa, Brassica napus; identical to SEQ ID NO: 1897
  misc_feature (1)..(92): Ceres CLONE ID no. 951040
  misc_feature: Utility: Useful for making smaller plants
  misc_feature: Utility: Useful for making taller plants

SEQ ID NO: 2410 - protein, 92 aa, Brassica napus
  misc_feature (1)..(92): Public GI no. 22331645
  misc_feature: Utility: Useful for making smaller plants
  misc_feature: Utility: Useful for making taller plants
MSSRKSRSRQTGASMITDEQINDLVLQLHRLLPELANNRRSGKVSASRVLQETCSYIRNLSKEVDDLSERLSQLLESTDSAQAALIRSLLMQ

SEQ ID NO: 2411 - protein, 91 aa, Glycine max
  misc_feature (1)..(91): Ceres CLONE ID no. 609713
  misc_feature: Utility: Useful for making smaller plants
  misc_feature: Utility: Useful for making taller plants
MSGQRRSSRTSKFTEIEINELVSRLQVLLLQVNQRGNSRQSASKILQETCCYIRKLQEEVEQLSERLSELMDSVDISDIDRRTLQNLLQQY

SEQ ID NO: 2412 - DNA, 665 bp, Arabidopsis thaliana
  misc_feature (1)..(665): Ceres CLONE ID no. 4309
  misc_feature (1)..(665): Also known as  Ceres CDNA ID no. 23384015
aacatatcacaacagagttgagtgagaaagaataagggattagaaaaagagagaatgggtaaggacaacaccagaatcctcatgcaattttcagctctcgcgatggttttaacagctgcaataatggtgaaagaagctacaagcattcccgtttgcaacattgacacaaacgacttggcgaaatgccgtccagccgtcactggaaacaaccctccaccaccgggaccggactgctgcgcagtggccagagttgctaatctacaatgcctctgcccgtacaagccttatctccccactgtcgggatagacccatctagagtcaggcctcttcttgccaattgtggtgtaaacagtccttcctgtttctaagcatgaagaactgacctgaagtcaggcccagtctcccacagactttgtcttgccctgaagtctctaagctataaatatgtcttttgctgttctgattcgcataaatatcaactttgcagtgatttttcagtcaccttatctattatatagatgaaccatgttctactgttaatgaaatgaaataaagtacttgtttttttgctaactccattgtgtactactttcttgagtatttaaaaattgactccttatgtatcttccgtgcaaagaacccaaatcataatattaagagatgc

SEQ ID NO: 2413 - protein, 104 aa, Arabidopsis thaliana
  misc_feature (34)..(103): Pfam Name: Tryp_alpha_amyl; Pfam Description: Protease inhibitor/seed storage/LTP family
  misc_feature (34)..(103): Pfam Name: Tryp_alpha_amyl; Pfam Description: Protease inhibitor/seed storage/LTP family
  misc_feature: Utility: Useful for making smaller plants
MGKDNTRILMQFSALAMVLTAAIMVKEATSIPVCNIDTNDLAKCRPAVTGNNPPPPGPDCCAVARVANLQCLCPYKPYLPTVGIDPSRVRPLLANCGVNSPSCF

SEQ ID NO: 2414 - DNA, 524 bp, Arabidopsis thaliana
  misc_feature (1)..(524): Ceres CLONE ID no. 11843
  misc_feature (1)..(524): Also known as  Ceres CDNA ID no. 23381280
gtcttctttcttcttcacttctgcctcttagggttaagcaagagagaaactagagatgaggttgataacgcacaacatgctttcctgcaacatcaaaggagtcaccagtggatttcctctacggatcgaagctgggaacgtgattgagaaggaagtcgatttcaatcccgattttatcaggcacatgttcgcgaagattgagtggaaagctctggtggaaggtgcgcgttccatgggatacgctgagttaccggaggaatctccggacgccgcggtgctgaaatcagatgagcccttccttaagaaactccaccacgcgttgctcgagctccaccttgaggaaggcgcgcttgtttgccctgagactggacggaagtttccggttaataaaggaatcccaaatatgcttctccatgaagacgaggtttaattgattgtgagatttttccttgtaagtttcaatctatgatgtttctgatgatgtgaaccttttagtgagatatgcaattgaatgattccatttg

SEQ ID NO: 2415 - protein, 124 aa, Arabidopsis thaliana
  misc_feature (2)..(124): Pfam Name: DUF343; Pfam Description: Protein of unknown function (DUF343)
  misc_feature: Utility: Useful for making smaller plants
MRLITHNMLSCNIKGVTSGFPLRIEAGNVIEKEVDFNPDFIRHMFAKIEWKALVEGARSMGYAELPEESPDAAVLKSDEPFLKKLHHALLELHLEEGALVCPETGRKFPVNKGIPNMLLHEDEV

SEQ ID NO: 2416 - protein, 123 aa, Brassica napus
  misc_feature (1)..(123): Ceres CLONE ID no. 1088130
  misc_feature: Utility: Useful for making smaller plants
MLSCNIKGVTNGFPLKIEAEKVVEKEVDFNPDFLRHMFAKIEWKALVEAARSMGYAELPEDSPDATVIDSADETFLRKLHHALLELHLEEGALVCPETGRKFPVNKGIPNMLLHEDEVNSIKS

SEQ ID NO: 2417 - protein, 118 aa, Brassica napus
  misc_feature (1)..(118): Ceres CLONE ID no. 946134
  misc_feature: Utility: Useful for making smaller plants
  misc_feature (118)..(118): Xaa is any aa, unknown, or other
MLSCNIKGVKNGFPLKIEAEKVIEKEVDFNPDFLRHMFAKIEWKALVEAARSMGYAELPEDSPDATVIESADETFLRKLHHALLELHLEEGALVCPETGRKFPVNKGIPNMLLHEDEX

SEQ ID NO: 2418 - protein, 126 aa, Brassica napus
  misc_feature (1)..(126): Ceres CLONE ID no. 1085859
  misc_feature: Utility: Useful for making smaller plants
MRLITHNMLSCNIKGVTNGFPLKVEAEKVIEKEIDFNPDFLRHMFAKIEWKALVEAACSLGYAELPEDSPDATVIESAADESLLKKLHHALLELHLEEGALVCPETGRKFPVNKGIPNMLLHEDEV

SEQ ID NO: 2419 - protein, 124 aa, Brassica napus
  misc_feature (1)..(124): Public GI no. 47606209
  misc_feature: Utility: Useful for making smaller plants
MRLIVHNMLSCNIKGVVNKFPLRIEAEKVTVKEVDFNPDFLRYMFAKIDWKALVDGARSMEYTELPDNAPDTTTLESDETFLRKFHHALLELHLEEGSLVCPETGRKFSVSKGIPNMLLHEDEV

SEQ ID NO: 2420 - protein, 117 aa, Brassica napus
  misc_feature (1)..(117): Public GI no. 30725332
  misc_feature: Utility: Useful for making smaller plants
MLSCNIKGVVNKFPLRIEAEKVTVKEVDFNPDFLRYMFAKIDWKALVDGARSMEYTELPDNAPDTTTLESDETFLRKFHHALLELHLEEGSLVCPETGRKFSVSKGIPNMLLHEDEV

SEQ ID NO: 2421 - protein, 115 aa, Glycine max
  misc_feature (1)..(115): Ceres CLONE ID no. 709877
  misc_feature: Utility: Useful for making smaller plants
  misc_feature (102)..(102): Xaa is any aa, unknown, or other
  misc_feature (113)..(113): Xaa is any aa, unknown, or other
  misc_feature (114)..(114): Xaa is any aa, unknown, or other
MLSSNIKGVVNGFPLRIEAEKVVEKTVEMNGEFLKKMFEKIDWKAFVDASRAMGYTELPEEADSSMLDSDEFLNRFHHALLELHLEEGVLVCPETGRRFPVXKGIPNMLLHEXXV

SEQ ID NO: 2422 - protein, 115 aa, Glycine max
  misc_feature (1)..(115): Ceres CLONE ID no. 479137
  misc_feature: Utility: Useful for making smaller plants
MLSSNIKGVVNGFPLRIEAEKVMEKTMEMNSEFLEKMFEKVDWKAFVDASRAMGYTELPEEANSSMLDSDEFLNRFHHALLELDLEEGALVCPETGRRFPVSKGIPNMLLHEDEV

SEQ ID NO: 2423 - DNA, 1087 bp, Arabidopsis thaliana
  misc_feature (1)..(1087): Ceres CLONE ID no. 14033
  misc_feature (1)..(1087): Also known as  Ceres CDNA ID no. 23370457
attagctcttcactgaaatctcataaaccctaaatccccaaaatggaataatcaaaatttcatcaggagatctctaaaatcgaaatctacttgatcccgcaacgaagaaatgttaagaagaagactcttgtcgatcatatcaacatcactcatcaattcttcgtttcatcaaaccgcgaaacccagattcatcatttcttcaccacttcttcaatgccgtccttctccgatctctactcaaattccgacctctacgagcagggctttgtcgtttcaaggaatcagggcttatagtttattgagcttgaacgatctgagagacaatgtgccgagaaaactcaagacgaggaaaggaagaggtattgggtctggtaaaggtaaaactgctggaagaggtcacaaggggcaaaaagcgagaggaacgatgaagtttggtttcgaaggtggtcagactccactacgacgtcgtttacccaaacgtggcttcaagaacaaatttaagctccattttcagccggttggtctagggaagattgctaaactcataaacgctgggaagatagattctcatgaattgattacaatgaaaacgctcaaggatgtgggagccataggaaagcaaatagaagatggagtaagactaatgggtcgtggtgctgatgatatcaaatggccacttcatttcgaggtttcgagagtgacggttagggccaaagaggtggtggaagcagcaggaggatcagtgagaagagtgtattacaacaagttgggcttaagggcattgcttaaaccggaatggtttgagaagaaaggaaggttattgccaaaagcagcgcgaccacctcctaaacaacaagataaggttgatagcattggacgtcttccagctccgaaaaaacccattcccttctttgcagctgaggagaccaaagttgaatctcctgttgaatcataattttgggctgccatttaacgtttgatgtttctgtttaagttgtttgtgttgtttcttggtcaatgttcaccactagaaaattgagaatgtcggattttaatttgacaaataaggtctttctcgttttacttt

SEQ ID NO: 2424 - protein, 281 aa, Arabidopsis thaliana
  misc_feature (64)..(162): Pfam Name: Ribosomal_L15; Pfam Description: Ribosomal protein L15 amino terminal region
  misc_feature (64)..(162): Pfam Name: Ribosomal_L15; Pfam Description: Ribosomal protein L15 amino terminal region
  misc_feature: Utility: Useful for making smaller plants
MLRRRLLSIISTSLINSSFHQTAKPRFIISSPLLQCRPSPISTQIPTSTSRALSFQGIRAYSLLSLNDLRDNVPRKLKTRKGRGIGSGKGKTAGRGHKGQKARGTMKFGFEGGQTPLRRRLPKRGFKNKFKLHFQPVGLGKIAKLINAGKIDSHELITMKTLKDVGAIGKQIEDGVRLMGRGADDIKWPLHFEVSRVTVRAKEVVEAAGGSVRRVYYNKLGLRALLKPEWFEKKGRLLPKAARPPPKQQDKVDSIGRLPAPKKPIPFFAAEETKVESPVES

SEQ ID NO: 2425 - protein, 295 aa, Arabidopsis thaliana
  misc_feature (1)..(295): Public GI no. 50508079
  misc_feature: Utility: Useful for making smaller plants
MWRRASHLLRATATATATAVSRRVPHPHPAPATAISTVLPAPKLASSLSYATQAAAAAAVPAARAPRTVGSLLRLNDLRDNPGARKQKTRKGRGIGSGKGKTAGRGHKGQKARGTARFGFEGGQTPLRRRLPRRGFKNRFSLTFQPCGLGKIAKLINAGKIDSSELITMKTLKDTGAIGKQIKDGIRLMGRGAEEIKWPIHLEVSRTTARAKAAVEAAGGTVRLVYYNNLGFRALLKPEWFAKKGRLLPKAARPPPKQRDKVDSIGRLPAPTKPLPFTPEELEFAAKREAARVIA

SEQ ID NO: 2426 - DNA, 775 bp, Arabidopsis thaliana
  misc_feature (1)..(775): Ceres CLONE ID no. 28528
  misc_feature (1)..(775): Also known as  Ceres CDNA ID no. 23646383
atagatacaagtgattgctatacatataacaaacacaagaaaacaccaaaagaccacatatccttccaatggccccccttcaacgcaccatctcggatatttcacaccaaatttcaatagacaacactctaacaaaagaaccatctccaaccgcaaccgcaacaactttgttatccttatcagcgatatccgaagtggaagatgcaaagtgtgagtgttgtggcatgtctgaagagtgcacgccggagtacatacaccgtgtgcgttcaaaattctcagggaagctgatttgcgggctgtgcgaaaaagcggtggagggggagatggagaagatgaacaacagtgaagtgctgatggagaagcggcgagaagaggcagtgaaggtacacatgagcgcatgttcccggttcaacaggctaggccggagttatccagtgttgtaccaagcagaagcggttaaggaaatgctgaaaaagaggtctaagaagatggttgtagccaccaagcctgaaaaaggtggcctcgctaggagctctagctgcatgccggctttagctaaggagcttaaagatcgtaccttggttaattagcttatttgtatactcacgtacacgtatgttatgttcatatatagatttgaatttacatgcagacggagatgtgtattaagtgagttatatatgtagttaaaaactgatggaagttttacgtgtgtaaattgtaatgtataatattttttcgtcaagtttattatcaatcaaacgtccgttttctc

SEQ ID NO: 2427 - protein, 173 aa, Arabidopsis thaliana
  misc_feature (43)..(159): Pfam Name: DUF1677; Pfam Description: Protein of unknown function (DUF1677)
  misc_feature: Utility: Useful for making smaller plants
  misc_feature: Utility: Useful for modifying fruit shape, composition and seed yield
MAPLQRTISDISHQISIDNTLTKEPSPTATATTLLSLSAISEVEDAKCECCGMSEECTPEYIHRVRSKFSGKLICGLCEKAVEGEMEKMNNSEVLMEKRREEAVKVHMSACSRFNRLGRSYPVLYQAEAVKEMLKKRSKKMVVATKPEKGGLARSSSCMPALAKELKDRTLVN

SEQ ID NO: 2428 - DNA, 521 bp, Arabidopsis thaliana
  misc_feature (1)..(521): Ceres CLONE ID no. 29009
  misc_feature (1)..(521): Also known as  Ceres CDNA ID no. 23383208
acttaaaccgaacagatttgtcacgaagaagaaatcagtgtagcaaacaccatccatccctgagcaaagatagaagaaaagctatgactgatttgcaaatggaggtagaggtagataccaattcttctttgcaggagtctctcccgaagccgcaagtcatgtacagatgtaagaaatgtagaaggatagttgctattgaggaaaacatagtcccgcatgaaccaggaaagggtgaagaatgctttgcttggaaaaagagaagtggaaactctgaacaagtgcaatgctcttccatctttgtcgagcctatgaaatggatgcagacaatacatgatggagtggtggaagagaagcttctatgttttggatgtaacgggagattaggttatttcaactgggctgggatgcaatgtagctgtggtgcatgggttaatccggcttttcagcttaataaaagccgaatagacgagtgtaaatccgagccaaacccgaacctgaatatggaaacttgatgaaaaagg

SEQ ID NO: 2429 - protein, 142 aa, Arabidopsis thaliana
  misc_feature: Utility: Useful for making smaller plants
MTDLQMEVEVDTNSSLQESLPKPQVMYRCKKCRRIVAIEENIVPHEPGKGEECFAWKKRSGNSEQVQCSSIFVEPMKWMQTIHDGVVEEKLLCFGCNGRLGYFNWAGMQCSCGAWVNPAFQLNKSRIDECKSEPNPNLNMET

SEQ ID NO: 2430 - protein, 137 aa, Zea mays
  misc_feature (1)..(137): Ceres CLONE ID no. 300070
  misc_feature: Utility: Useful for making smaller plants
MFEDDPGLSLESGSCQDSSKVEQRKTAYRCRKCRRVIAVEGNVISHVPGEGESCFDWNRRKSGHPYNNKEHGCSSLFVEPLKWMTPVEDGALEGKLSCIHCGARLGYFNWSGIQCNCGSWVTPAFQIVKSKVDISTI

SEQ ID NO: 2431 - DNA, 1696 bp, Arabidopsis thaliana
  misc_feature (1)..(1696): Ceres CLONE ID no. 32574
  misc_feature (1)..(1696): Also known as  Ceres CDNA ID no. 23377569
atcctgagaatggtcacaaattctctacctctctctctctctctctctggtagagaaaatggagatatcagttgcatcggtaacagtttctgtagctgtagttgttgtgtcatggtgggtatggagaactttacagtgggtttggcttaaaccaaagatgcttgagagttacctgagaagacaaggtcttgccggaactccttacacgcctcttgtcggtgatttgaagagaaattttagcatgctggctgaggcaagatccaaacccatcaacctaacagatgatatcacaccacgtatcgtgccttatccgttgcaaatgctcaagactcatgggaggactttctttacatggtttggacccataccaacaatcaccataatggatcctgagcaaatcaaagaagtgttcaacaaagtttatgatttccagaaggcacatacgtttcctctgggcagattaatagcggctggactcgttagttatgatggtgataaatggacaaaacaccgaagaatcatcaacccggctttccaccttgagaagatcaaaaatatggtacctgcgttccaccagagctgcagcgagattgttggcgaatgggacaagttagtgacggataaacagtcatcctgtgaggtggatatttggccttggcttgtgagtatgactgcagatgtgatctcccgtactgcatttggcagcagctacaaagaagggcagaggatatttgagctccaagcggaattagcacagctcatcattcaagcttttcggaaagctattatccctggatatcgttatcttcctacaaagggtaatagaaggatgaaagcagcagctagagaaatcaaatttatactgagagggatcgttaacaaaaggcttagggcaagagacctggggaagcaccaagtgacgatttgctgggtatacttcttgaatcgaatttgggacaaacaaaaggaaatggaatgagtaccgaggaactgatggaggagtgcaagttgttctatttcgctgggcaagagactactacagtacttctggtttggacaatggtgttgttaagccaacaccaagattggcaggctcgtgcaagagaagaagtgaagcaagtttttggcgataaagaacctgatgcagaaggcttgaaccagctcaaagttgtaagtaaaccgaaccaaaaaccttcaagtgacgtgagttctttcgttgcattgaagctgaaagatttgatccctcacagatgacgatgatattatatgaagtccttaggctatatcctccagtagtccagctgacccgagccattcacaaagagatgcagctaggtgacctgacactaccaggcggcgttcagataagtctaccaattctgctaatccaacgcgacagggagctgtggggaaacgatgcaggggagttcaagccagatagattcaaagacggtctctcaaaggcaacaaagaaccaagtctccttctttccttttgcgtggggaccgaggatctgcattggccaaaattttgcactgcttgaggcaaagatggcaatgacactgattctacggaaattctcctttgagctttctccttcttatgtttcacgcgccttacacagtcctcactactcacccacagttcggtgctcctctcatcttgcacaagctctaatcgtataaaccccttgttc

SEQ ID NO: 2432 - protein, 306 aa, Arabidopsis thaliana
  misc_feature (90)..(285): Pfam Name: p450; Pfam Description: Cytochrome P450
  misc_feature (90)..(285): Pfam Name: p450; Pfam Description: Cytochrome P450
  misc_feature: Utility: Useful for making smaller plants
MEISVASVTVSVAVVVVSWWVWRTLQWVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKNMVPAFHQSCSEIVGEWDKLVTDKQSSCEVDIWPWLVSMTADVISRTAFGSSYKEGQRIFELQAELAQLIIQAFRKAIIPGYRYLPTKGNRRMKAAAREIKFILRGIVNKRLRARDLGKHQVTICWVYFLNRIWDKQKEME

SEQ ID NO: 2433 - protein, 512 aa, Arabidopsis thaliana
  misc_feature (1)..(512): Ceres CLONE ID no. 1012695
  misc_feature: Utility: Useful for making smaller plants
MEISVASVTISVVLAVVSWWIWRTLQWVWFKPKMLEHYLRRQGLAGTPYTPLVGDLKKNFSMLSEARSKPLKLTDDISPRVVPYPLQMFKTYGRTYFTWFGPIPTITIMDPEQIKEVFNKVYDFQKPHTFPLATIIAKGLANYDGDKWAKHRRIINPAFHIEKIKNMVPAFHQSCREVVGEWDQLVSDKGSSCEVDVWPGLVSMTADVISRTAFGSSYKEGQRIFELQAELAQLIIQAFRKAFIPGYSYLPTKSNRRMKAAAREIQVILRGIVNKRLRAREAGEAPSDDLLGILLESNLRQTEGNGMSTEDLMEECKLFYFAGQETTSVLLVWTMVLLSQHQDWQARAREEVKQVFGDKEPDAEGLNQLKVMTMILYEVLRLYPPVTQLTRAIHKELKLGDLTLPGGVQISLPILLVQHDIELWGNDAAEFNPDRFKDGLSKATKSQVSFFPFAWGPRICIGQNFALLEAKMAMALILRRFSFEISPSYVHAPYTVITIHPQFGAQLIMHKL

SEQ ID NO: 2434 - protein, 527 aa, Zea mays
  misc_feature (1)..(527): Ceres CLONE ID no. 1573884
  misc_feature: Utility: Useful for making smaller plants
MATCVLLMLREVSPWALASVVASVSLLWLVVWTLEWAWWTPWRLERALRVQGLKGTRYRLFTGDLRETARANREARKKPLPLGSHDIAPRVQPMHHSTIKEYGKLSFTWFGPTPRVMIPDPELVKEVLSNKFGHFGKPRSNRIGRLLANGLVNHDGEKWAKHRRILNPAFHHEKIKGMMPVFSTCCIEMITRWDNSMPSEGSSEIDVWPEFQNLTGDVISRTAFGSNYQEGRRIFELQGELAERLIQSVQTIFIPGYWFLPTKNNRRMRAIDVEIRKILREIIGKREKDTKNRETNNDDLLGLLLESNTRQSNGNASLGLTTEDVIEECKLFYFAGMETTSVLLTWTLIVLSMHPEWQERAREEVLSHFGRTTPDYDSLSRLKTITMILHEVLRLYPPATFLTRRTYKEMELGGIKYPAGVDLLLPVIFIHHDPDIWGKDASEFNPERFANGISSATRHQAAFFPFGGGPRICIGQSFALLEAKMTLCTILQRFSFELSPSYTHAPYTVITLHPQHGAQIRLKKLSP

SEQ ID NO: 2435 - protein, 523 aa, Glycine max
  misc_feature (1)..(523): Ceres CLONE ID no. 479101
  misc_feature: Utility: Useful for making smaller plants
MEAPWATTSSSIVFVIVILALTSWAWRMLNWLWIRPKRLERLLREQGLQGNPYRILVGDLKEIVKLQMEARSKPMNLSHDIVPRVFAHLHQSVLKHGKNSFIWFGPKPRVTLTDPELIKDVLNKISDFRKPEANPLAKLLATGLVNYDGEKWNKHRRLINPAFSLEKLKIMLPIFFKSCNDLIIKWEGMLSYDGSCEMDVWPFLQNLASDVIARTAFGSSFEEGKRIFQLQKELAELTMKVIMKVYIPGWRFVPTATNRRMKEIDRYIKASLTDMIKKREKAPKTGEATRDDLLGILLESNHKEIQEHRNNENVGMNLNDVIEECKLFYFAGQETTSVLLVWTMVLLSRYPDWQSRAREEVLQVFGKQAPNFDGLSHLKIVTMILYEVLRLYPPGIGLTRSVHRDMKLGNLTLPAGVQVSLPIIMVHHDRELWGDDAKEFNPERFSEGVSKATNGRVSFFPFGWGPRICIGQNFSLLEAKMALSMILQHFSFELSPAYTHAPFTVITLQPQYGAHVILRKVEM

SEQ ID NO: 2436 - protein, 502 aa, Glycine max
  misc_feature (1)..(502): Ceres CLONE ID no. 546712
  misc_feature: Utility: Useful for making smaller plants
MLILILALIWVWKKFNSLWLTPKRLEKILREQGLRGSPYRFKVGDTKETLKMQMQAMSKPMNLFSNDIGPRVSPYDHYIVNKHGKNSFIWNGQTPRVTLTDPELIKDVFNKIYDFGKPNMGPNIRSLIPGLAMHEGEKWSKHRKIINPAFNLEKLKNMLPLFIQCCDDLISKWEEMLSSDGSSEIDVWPFVKNLTADVISRTAFGSSYLEGRRIFQLLKEKIELTLKMRGQRLVPKRMKEIDRDIKASLMDIINKRDKALKAGEATKNNLLDILLESNHKEIEEHGNNKNVGMNIEEVIEECKLFYFAGQDTTSVLLVWTMILLSRYPDWQARAREEVSQVFGNQKPTFDGLNQLKIVTMILYEVLRLYPPGVGVPRKVIKDVKLGNLSFPAGVEIFISTILVHHDSELWGDDAKEFKPERFSEGVLKATNGRFSFFPFGGGPRICIAQNFALLEAKIALSMILQCFSFELSPTYTHAPTMVMTIQPQYGAPVILHKVEKYE

SEQ ID NO: 2437 - DNA, 447 bp, Arabidopsis thaliana
  misc_feature (1)..(447): Ceres CLONE ID no. 32612
  misc_feature (1)..(447): Also known as  Ceres CDNA ID no. 23557580
aaaaactcgtcttcaagctgtctatattttctccggcgagcggtgctgataacttcgtagctccgaaacgccgccatggccgcagaatttgatggaaaaatcgaaagcaaagggctaaacccgggactgatcgtccttcttgtaataggagggttgctactgacattccttgtaggaaacttcatcctttacacatacgcacagaagaatttacctccgaggaagaagaaacccgtttctaagaagaagatgaagaaagagaagatgaagcaaggcgtccaagttcctggcgagtagcttttgttatatgttgtcgggattatcctttgatgataactcactctgctggactagaacttgtatgactccgttactctttagttttttgatgttttcgatgtagcatgcatgatattttcttgagttgacaatctataagctttactg

SEQ ID NO: 2438 - protein, 73 aa, Arabidopsis thaliana
  misc_feature (4)..(73): Pfam Name: S1FA; Pfam Description: DNA binding protein S1FA
  misc_feature: Utility: Useful for making smaller plants
MAAEFDGKIESKGLNPGLIVLLVIGGLLLTFLVGNFILYTYAQKNLPPRKKKPVSKKKMKKEKMKQGVQVPGE

SEQ ID NO: 2439 - protein, 73 aa, Brassica napus
  misc_feature (1)..(73): Ceres CLONE ID no. 1068098
  misc_feature: Utility: Useful for making smaller plants
MADEFSGKIESKGLNPGLIVLLVIGGLLVTFLVGNFILYTYAQKNLPPRKKKPVSKKKMKKEKLKQGVQVPGE

SEQ ID NO: 2440 - protein, 70 aa, Brassica napus
  misc_feature (1)..(70): Public GI no. 498705
  misc_feature: Utility: Useful for making smaller plants
MAVNEVEAKGLNPGLIVLLVIGGLLLTFLVGNFILYTYAQKNLPPKKKKPISKKKMKRERLKQGVAPPGE

SEQ ID NO: 2441 - protein, 82 aa, Glycine max
  misc_feature (1)..(82): Ceres CLONE ID no. 563046
  misc_feature: Utility: Useful for making smaller plants
MADDFEFADKVPPSFDRAGSKGFNPALIVLLLVGGLLLTFLIGNYVLYTYAQKTLPPRKKKPVSKKKMKKERLKQGVSAPGE

SEQ ID NO: 2442 - protein, 82 aa, Triticum aestivum
  misc_feature (1)..(82): Ceres CLONE ID no. 737633
  misc_feature: Utility: Useful for making smaller plants
MADDFEFSDKVPPSFDRVGSKGFNPALIVLLLVGGLLLIFLVGNYVLYTYAQKTLPPRKKKPISKKKMKKERLKQGVSAPGE

SEQ ID NO: 2443 - protein, 82 aa, Glycine max; identical to SEQ ID NO: 2442
  misc_feature (1)..(82): Ceres CLONE ID no. 1607819
  misc_feature: Utility: Useful for making smaller plants

SEQ ID NO: 2444 - protein, 83 aa, Parthenium argentatum
  misc_feature (1)..(83): Ceres CLONE ID no. 1608024
  misc_feature: Utility: Useful for making smaller plants
MDYESDPSFDKSQFVNKNVEATGFNPGLIVLLVVGGLLITFLVGNYVLYMYAQKTLPPRKKKPVSKKKLKREKLKQGVAVPGE

SEQ ID NO: 2445 - protein, 80 aa, Parthenium argentatum
  misc_feature (1)..(80): Public GI no. 38347601
  misc_feature: Utility: Useful for making smaller plants
MADQFADSANNVVIEEVNKGLNPGMIVLIVVATFLLLFFVGNYALYVYAQKTLPPRKKKPVSKKKMKREKLKQGVSAPGE

SEQ ID NO: 2446 - protein, 76 aa, Parthenium argentatum
  misc_feature (1)..(76): Public GI no. 38347600
  misc_feature: Utility: Useful for making smaller plants
MADQSNNMIIEEVNKGLNPGTIVLLVVATLLILFFVGNYALYMYAQKTLPPRKKKPVSKKKLKREKLKQGVSAPGE

SEQ ID NO: 2447 - protein, 63 aa, Parthenium argentatum
  misc_feature (1)..(63): Public GI no. 1173349
  misc_feature: Utility: Useful for making smaller plants
  misc_feature (11)..(11): Xaa is any aa, unknown, or other
  misc_feature (30)..(30): Xaa is any aa, unknown, or other
NKGLNPGMVVXLVVASFLLIFFVGNYALYXYAQKTLPPKKKKPVSKKKLKKEKLKQGVSAPGE

SEQ ID NO: 2448 - protein, 56 aa, Zea mays
  misc_feature (1)..(56): Ceres CLONE ID no. 273675
  misc_feature: Utility: Useful for making smaller plants
MVVLLVVASFLLIFFVGNYALYVYAQKTLPPKKKKPVSKKKLKKEKLKQGVSAPGE

SEQ ID NO: 2449 - protein, 80 aa, Zea mays
  misc_feature (1)..(80): Ceres CLONE ID no. 289176
  misc_feature: Utility: Useful for making smaller plants
  misc_feature (3)..(3): Xaa is any aa, unknown, or other
  misc_feature (44)..(44): Xaa is any aa, unknown, or other
MAXQFADSANNVIIEEVNKGLNPGMVVLLVVASFLLLFFAGNYXLYVYAQKTLPPKKKKPVSKKKLKREKLKQGVSAPGE

SEQ ID NO: 2450 - protein, 80 aa, Zea mays
  misc_feature (1)..(80): Ceres CLONE ID no. 984214
  misc_feature: Utility: Useful for making smaller plants
MADQFADSANNVIIEEVNKGLNPGMVVLLVVASFLLLFFAGNYALYVYAQKTLPPKKKKPVSKKKLKREKLKQGVSAPGE

SEQ ID NO: 2451 - protein, 80 aa, Zea mays; identical to SEQ ID NO: 2450
  misc_feature (1)..(80): Ceres CLONE ID no. 1444070
  misc_feature: Utility: Useful for making smaller plants

SEQ ID NO: 2452 - protein, 56 aa, Zea mays
  misc_feature (1)..(56): Ceres CLONE ID no. 219485
  misc_feature: Utility: Useful for making smaller plants
MVVLLVVASFLLLFFAGNYALYVYAQKTLPPKKKKPVSKKKLKREKLKQGVSAPGE

SEQ ID NO: 2453 - DNA, 1133 bp, Arabidopsis thaliana
  misc_feature (1)..(1133): Ceres CLONE ID no. 36094
  misc_feature (1)..(1133): Also known as  Ceres CDNA ID no. 23359771
atttttaatagactatcaaaaaaacaatctcatttcatttgctctcttctccgagaaaatggcgtttggtttgatcggaagagttgttggaacgaaaccgtcacgattatccacggcggcgcgattgattccggcgcgatggacatcaaaaggatcagaagcacaatcgaaagcttcaaccggcggcggaggagcgagtctgaagacgtttcagatctatcgatggaatccagataatcctggaaagccagagcttcaagattacaaaatcgatctcaaggattgtggtccaatggttctagatgctttgattaagattaagaacgagatggatccatcgctcactttccgtcgctcttgccgtgaaggtatttgtggttcgtgtgctatgaacattgatggatgtaatggtcttgcttgtttaacgaagattgaatctggatctaaagagacgacgattacgccgttgccgcatatgtttgtgattaaggatttggttgtggatatgacgaatttttataatcagtataagagtattgagccgtggttgaagaggaagaatccagcatctgttcctgggaaagagattttacagagtaagaaagatagagctaagcttgatggaatgtatgaatgtattctctgtgcttgttgtagcacgtcttgccctagctattggtggaaccctgagtcttatcttggtccagctgctttgcttcatgccaacaggtggataagtgatagccgagatgagtacactaaggaaagacttgaagccattgacgatgagttcaaactgtatcgatgccacacaattctgaactgtgctcgtgcctgtccaaagggattgaacccagggaaacagatcacacacatcaagcagcttcagaaatctggttgaacaacaaatgaatcaggcagtacctaatggatttttgattctaataatctgcaagaaactccaattttggattcattcttgtattgctgtcacaactatcagaattagattattttgtggtatatcttgatgaattttttttgcctacaacaagcaataaaactctgctttttttatcatccactcattcagctttgccttaatacaaacatttggatttcgagttttgctc

SEQ ID NO: 2454 - protein, 280 aa, Arabidopsis thaliana
  misc_feature: Utility: Useful for making smaller plants
MAFGLIGRVVGTKPSRLSTAARLIPARWTSKGSEAQSKASTGGGGASLKTFQIYRWNPDNPGKPELQDYKIDLKDCGPMVLDALIKIKNEMDPSLTFRRSCREGICGSCAMNIDGCNGLACLTKIESGSKETTITPLPHMFVIKDLVVDMTNFYNQYKSIEPWLKRKNPASVPGKEILQSKKDRAKLDGMYECILCACCSTSCPSYWWNPESYLGPAALLHANRWISDSRDEYTKERLEAIDDEFKLYRCHTILNCARACPKGLNPGKQITHIKQLQKSG

SEQ ID NO: 2455 - protein, 279 aa, Arabidopsis thaliana
  misc_feature (1)..(279): Ceres CLONE ID no. 14357
  misc_feature: Utility: Useful for making smaller plants
MASGLIGRLVGTKPSKLATVARLIPVRWTSTGAEAETKASSGGGRGSNLKTFQIYRWNPDNPGKPELQNYQIDLKDCGPMVLDALIKIKNEMDPSLTFRRSCREGICGSCAMNIDGCNGLACLTKIQDEASETTITPLPHMFVIKDLVVDMTNFYNQYKSIEPWLKRKTPASVPAKEILQSKKDRAKLDGMYECILCACCSTSCPSYWWNPESYLGPAALLHANRWISDSRDEYTKERLEAIDDEFKLYRCHTILNCARACPKGLNPGKQITHIKQLQR

SEQ ID NO: 2456 - protein, 282 aa, Zea mays
  misc_feature (1)..(282): Ceres CLONE ID no. 265075
  misc_feature: Utility: Useful for making smaller plants
MAAALLRRSPAARALLSPALSSRLVASKPHSSSPAPPPPAKADSSTKTFSIYRWDPDSPSTKPHLKDYQVDLSDCGPMVLDALLKIKNEQDPSLTFRRSCREGICGSCAMNIDGDNGLACLTKISGASSASTVSPLPHMFVVKDLVVDMTNFYSQYKSVEPWLKRKDQPPQQGKEIPQTKADRAKLDGMYECILCACCSTSCPSYWWNPEEYLGPAALLHANRWIQDSRDQFTKERLDAINDEFKLYRCHTIKNCTHACPKGLNPAKQIDTIKKLQLGAPSA

SEQ ID NO: 2457 - protein, 279 aa, Zea mays
  misc_feature (1)..(279): Ceres CLONE ID no. 1000303
  misc_feature: Utility: Useful for making smaller plants
MAAALLRRSPAVRALLSPALSSRLVASKPHSSSPAPPPPAKAASSTKTFSIYRWDPDSPSTKPHLKDYQVDLSDCGPMVLDALLKIKNEQDPSLTFRRSCREGICGSCAMNIDGDNGLACLTKISAASSASTVSPLPHMFVIKDLVVDMTNFYNQYKSVEPWLKRKDPPPQLGKEVPQTKADRAKLDGMYECILCACCSTSCPSYWWNPEEYLGPAALLHANRWIQDSRDQFTKERLDAINDEFKLYRCHTIKNCTHACPKGLNPAKQIDTIKKLQLDA

SEQ ID NO: 2458 - DNA, 390 bp, n/a
  misc_feature (1)..(390): Ceres CLONE ID no. 97031
  misc_feature (1)..(390): Also known as  Ceres CDNA ID no. 13607442
aaagcctcatcctcatactcactaagttttagaccaatcttgattcgtagattttatttttggaagatgtacggtgtcggtggatcgagcacagcgggtttcgcagaagcttacgcgatgaggaagatttataaagaaaagatgaagatgaagcttgcagaggcaaaagtagaggaagaaaaagaaaatgttggaggtaagagtaaaatctggaaaacgaagaaatctaagaagaccctccatactaatccaagggtttcctctgcagatatttaaacatctatatgtatatggttatgtattttttttttttcttaactttttatgattggttcattttgttcttttgtgtaatattttttttacagttaataacaaagaattatattg

SEQ ID NO: 2459 - protein, 69 aa, n/a
  misc_feature: Utility: Useful for making smaller plants
MYGVGGSSTAGFAEAYAMRKIYKEKMKMKLAEAKVEEEKENVGGKSKIWKTKKSKKTLHTNPRVSSADI

SEQ ID NO: 2460 - DNA, 653 bp, Arabidopsis thaliana
  misc_feature (1)..(653): Ceres CLONE ID no. 115966
  misc_feature (1)..(653): Also known as  Ceres CDNA ID no. 23385468
atcaatcttacatccaaaacttaaagtattcttacatccaaaaacaaaaaaaatatggcaaagtctcttctcatagtaatgctcatgtctatagtaatgttttacatggctcgtccaattttctcccaaaaaattaatccatatttagaggtgatgccagaagatgtgaccatatctccatcttcagattttgattacgtcgaagctccctatgaagctccattcgaagaagctgattcaccagcaatggaatatgacatggagcttgctcaccattattcggacaaacagttcaagtttcttgaggcttgctctgaaaagccgagttcaaaatgcggaaatgaggttttcaagaacatgttaaatgagacgatgccaattacagaagaatgttgtcgtgatatattgaagatgggcaaagattgccatctaggattggttaaactcatatttgccacatatgagtataaaaatattgcatctaagggcattccaaagagcaaacaaacatggaacgaatgtgtccgtagagtggggagcaagattggtgctccggtctcttttgaacaataaactaatatttccgtgtattgatgtgtctatgcgtttttgtaatttgattattactattataaagcaactgctactatttt

SEQ ID NO: 2461 - protein, 172 aa, Arabidopsis thaliana
  misc_feature (34)..(172): Pfam Name: DUF784; Pfam Description: Arabidopsis thaliana protein of unknown function (DUF784)
  misc_feature: Utility: Useful for making smaller plants
MAKSLLIVMLMSIVMFYMARPIFSQKINPYLEVMPEDVTISPSSDFDYVEAPYEAPFEEADSPAMEYDMELAHHYSDKQFKFLEACSEKPSSKCGNEVFKNMLNETMPITEECCRDILKMGKDCHLGLVKLIFATYEYKNIASKGIPKSKQTWNECVRRVGSKIGAPVSFEQ

SEQ ID NO: 2462 - protein, 172 aa, Arabidopsis thaliana
  misc_feature (1)..(172): Public GI no. 10998140
  misc_feature: Utility: Useful for making smaller plants
MAKSLLIVMLMSIVMFYMARPIFSQKINPYLEVMPKDVTISPSSNFDYVEAPDEAPFEEADSPAMEYDMELAHHYSDKQLKFLEACSEKPSSKCGNEVFKNMLNETMLITEECCRDILKMGKDCHLGLVKLIFATYEYKNIASKGIPKSKQTWNECVHRVGSKIGAPVSFEQ

SEQ ID NO: 2463 - protein, 172 aa, Arabidopsis thaliana
  misc_feature (1)..(172): Public GI no. 25405889
  misc_feature: Utility: Useful for making smaller plants
MAKSLLMVMLVSIVMFYMARPICSQKINPHSQEMPEDVAISPSSDFDYVEAPDEAPFEEADSPAMEYDRELAHHYSDKQLKFLEACSEKPSSKCGNEVFKNMLNETMPITEECCRDILKMGKDCHLGLVKLIFATYEYKNIASKGIPKSKQAWNECIRRVGSKIGAPVSFEQ

SEQ ID NO: 2464 - protein, 156 aa, Arabidopsis thaliana
  misc_feature (1)..(156): Public GI no. 15220229
  misc_feature: Utility: Useful for making smaller plants
MARPIFSQEIDPYSQEVPKDVAISPSSKFDIYVEAPGEAPFEEADSPAMEYDRELAHHYSHKQLDFLEACSEKPSSKCGNEVFKNMLDETVPITDECCRDILKIGKDCHLGLVKLIFATYEYKNKASKGIPKSKQTWNECVFRVGSKIGAPVSFEQ

SEQ ID NO: 2465 - protein, 149 aa, Arabidopsis thaliana
  misc_feature (1)..(149): Public GI no. 18413965
  misc_feature: Utility: Useful for making smaller plants
MAKSLLMVMLVSIVMFYMACPIFSQEIHEDVAISPTPFEEANSPAMEYDMKLPHYSQKQYDFLEACVEKPSSICGGEIFQNVLDATTLVTDKCCRDILKIGKDCHLGLIKIFFSSYEYKNIASIPRNKQTWNDCLRRVGSKIGVPVSSE

SEQ ID NO: 2466 - protein, 149 aa, Arabidopsis thaliana
  misc_feature (1)..(149): Public GI no. 18413969
  misc_feature: Utility: Useful for making smaller plants
MAKSLLMVMLVSIVMFYMACPIFSQEIHEDVAISPTPFEEANSPAMEYDMKLPHYSQKVFDFLETCAEKPSSICGGEIFQNVLDATTLVTDKCCRDILKIGKDCHLGLIKIFFSSYEYKNIASIPRSKQTWNDCFRRVGSKIGVPVSIE

SEQ ID NO: 2467 - protein, 149 aa, Arabidopsis thaliana
  misc_feature (1)..(149): Public GI no. 8953752
  misc_feature: Utility: Useful for making smaller plants
MAKSLLMVMLVSIVMFYMACPILSQEVHEDVVISPTPFEKAISPAMEYEMKLPHYSQKQYDFLEACVEKPSSICGGEIFQNVLDETNLVTDKCCRNILKIGKDCHLGLMKILFSSYEYKNIASIPRSKQTWNDCLRRVGSKIGVPVSFE

SEQ ID NO: 2468 - protein, 148 aa, Arabidopsis thaliana
  misc_feature (1)..(148): Public GI no. 7267642
  misc_feature: Utility: Useful for making smaller plants
MFDPTYIEHLYHNIPSECWLVAENEIHEDVAISPTPFEEANSPAMEYDKKLPHYSQKVFDFLETCAEKPSSICGGEIFQNVLDATTLVTDKCCRDILKIGKDCHLGLIKIFFSSYEYKNIASIPRSKQTWNDCFRRVGSKIGVPVSIE

SEQ ID NO: 2469 - protein, 169 aa, Arabidopsis thaliana
  misc_feature (1)..(169): Public GI no. 15220221
  misc_feature: Utility: Useful for making smaller plants
MTKTLLMVTLVSIVMFYMARPIFSQEIDPYSLEVLEDVALSSSSKFNIYVEAPDEALFEEADSPAIEYDKDRYKIPDFIAACAMKQSWICLNVVFENMKDEMMPIINECCREILKMGKDCHFRLVEGWSAMYVYGNSIASKDIPYSKQSWNECVRRVGSKFGAPVSFEQ

SEQ ID NO: 2470 - protein, 151 aa, Arabidopsis thaliana
  misc_feature (1)..(151): Public GI no. 22325451
  misc_feature: Utility: Useful for making smaller plants
MAKSFLMVMLASMVMFYMACPIYSQKNISEDIDIAPTSVEGADLPTTEYEIELAHRLHEDYILACPKKPSSKCDDEIFNNMMDGTTPVTSECCRDILKTGKDCHLALVKIVFSTDGYKSKASRAIPKSKQTWNDCVRRVGMEIGAPVTFEA

SEQ ID NO: 2471 - protein, 157 aa, Arabidopsis thaliana
  misc_feature (1)..(157): Public GI no. 22325449
  misc_feature: Utility: Useful for making smaller plants
MAKSILMAILVSILTFSMVCLICSQKIHHYSKEISEDVDISPTSVEGADSPTTEYEIKLAHRLHEDYILACPKKPSSKCDDEIFQNMLDGTTPVTNECCLDILKTGKDCHLALVKIIFSTDDYKNIASRAIPKSKQTWNDCARRVSKEIGAPISFEQ

SEQ ID NO: 2472 - DNA, 1268 bp, Arabidopsis thaliana
  misc_feature (1)..(1268): Ceres CLONE ID no. 121021
  misc_feature (1)..(1268): Also known as  Ceres CDNA ID no. 23365088
agaaaaaatgggcaacataaataaaaagtaaaagggctctctctcctttctttcagtttcgacattccccagaatctctcttccctttttgtctccaaccaaaacaaaaccttaatcacctttcttcttcttcaaacagagcacaacagagacgttcgttcccactctgtcttaatctcccctgtttcaattcctaaatcgatggaaaacggtggaacaattccgggtcaagaaatcggatcagggcttcaaaaacccgttaacccagatgggtttgtgacgatcgatgttgaaagtttctctagtgtcatccacaaagacttctcttcttctagtccaagaattactttgcagaggaatgtatcgaggaaagggtctccaagaagcaacaacgagagaaaactccattttgacgcaaatggtaatgacaaggagatctcatttcctcagtccccacttagagggtcaagcacgccggaaaaggctagcaccgtgggccccacagaacatgcaggcacggccacaaccgctgccacagctgtttcagcctcgccgcttcatcagatcaccgttactacggctgccacggccgcaggaaatatgattaccgaccaaaatagagaaagaaggttcggtttttcgaggaaatcgagttttaaacgctctcacacttcttggatgcttgatccgaagaaaatcgtcctcttctttgcaactttgtcaagcatgggatcaatcttgttaatcatattcacactctcgatcagcaagtccaatcccggagatatgcctctagactaatagtaaacacacgaagagcattatatataacgcatatatatcatcgaccgacctaagtttgtggccatagaacatgccacagtctcaccgacctacattttaaggagatgtatcagacagaagaacattacaaaaaatgaagagggtaaggttgtgataatagttttatttcgtatgattttttttaaatgaaaaaaaagaagaagacaacagtaagagagagagaaagtgggaagtgggcacgcacgagatcatatgggagattggaaaagaaagcttaagacaagagtttatgactattgtgacaaagacagagaatcttctcttctgttctttcaaattcttttttctctgttttttctttaaatttatttatcgagtatgtgtttcgattgtcttcaatatgttctctatgtgtacatatcaattgcggtgactggtgagcaattttagtttcgtttggtttt

SEQ ID NO: 2473 - protein, 199 aa, Arabidopsis thaliana
  misc_feature: Utility: Useful for making smaller plants
  misc_feature: Utility: Useful for modifying plant architecture, ie amount of  branching
MENGGTIPGQEIGSGLQKPVNPDGFVTIDVESFSSVIHKDFSSSSPRITLQRNVSRKGSPRSNNERKLHFDANGNDKEISFPQSPLRGSSTPEKASTVGPTEHAGTATTAATAVSASPLHQITVTTAATAAGNMITDQNRERRFGFSRKSSFKRSHTSWMLDPKKIVLFFATLSSMGSILLIIFTLSISKSNPGDMPLD

SEQ ID NO: 2474 - protein, 203 aa, Glycine max
  misc_feature (1)..(203): Ceres CLONE ID no. 1121512
  misc_feature: Utility: Useful for making smaller plants
  misc_feature: Utility: Useful for modifying plant architecture, ie amount of  branching
  misc_feature (109)..(109): Xaa is any aa, unknown, or other
MAEIPKLDLSSSCFDNGEPLDSEQKSQKIFVSDHINAFQYADEKADSFVIDMDAFSSGHNKDATNANSRITLQRSLSRKGSQRLGDWKLNNNATLYDKDTVPAICSPKXTLVGPFTPEKPAGMAVGPMGHSMNPHVHNLTADNIPTESKCSITRRNSFRRPSSWAIDPKRVLLFFATLSSMGTMLLIYFTLTISKQSAEEYGG

SEQ ID NO: 2475 - protein, 192 aa, Glycine max
  misc_feature (1)..(192): Ceres CLONE ID no. 1046846
  misc_feature: Utility: Useful for making smaller plants
  misc_feature: Utility: Useful for modifying plant architecture, ie amount of  branching
MGTQRILVSDHINAYQYSAEEADSFVIDMDSFSSGINKDSNNANSRITLQRSLSRKGSQRGGDRKVNGNVTLHDRDTAPTTCSPKAALAGSCTAEKSAVVAVGSTHHSTNTQVHHQITITASNMCTTTTPTTESKCITRRNSFKRSSSWLLDPKRVLLFFATLSSMGTMLLIYFTLTLSKQNADEYGGDWQQ

SEQ ID NO: 2476 - DNA, 523 bp, Arabidopsis thaliana
  misc_feature (1)..(523): Ceres CLONE ID no. 248859
  misc_feature (1)..(523): Also known as  Ceres CDNA ID no. 23371046
atcaaggtaagacacttcgcttcaaatcatttgtgtattacagaaacttctgatcgtcatggaagctacttcacaaccatgtttctctcataactcctcacttcattcgacccgtaagcaaccggcaaacccatggaaaaaacccgtaacgggcttgcctcagaggatgcatcctaaagtttacagagtcgagcctgttaacttcaaggagttagttcagaggctaactggtgcagaagacgttgagcaagaggtacatcaagttgaagctaaaccagtcaagatttctgatgatacaacaacagctaaggataatccgttcgcgtttgatctttcaccttcgtcatctcggttctgggaagctttccctctgcttagtcctgctaatctatcaagatggtagcgagaaagaagctattcttgccaatttttcggcaattcatgaatttgtttcatcagaattagaactgtagtagtaacactttatgatcttatctttaaatacaaaagttactgttacatt

SEQ ID NO: 2477 - protein, 114 aa, Arabidopsis thaliana
  misc_feature (35)..(65): Pfam Name: VQ; Pfam Description: VQ motif
  misc_feature: Utility: Useful for making smaller plants
MEATSQPCFSHNSSLHSTRKQPANPWKKPVTGLPQRMHPKVYRVEPVNFKELVQRLTGAEDVEQEVHQVEAKPVKISDDTTTAKDNPFAFDLSPSSSRFWEAFPLLSPANLSRW

SEQ ID NO: 2478 - protein, 138 aa, Brassica napus
  misc_feature (1)..(138): Ceres CLONE ID no. 1126651
  misc_feature: Utility: Useful for making smaller plants
MEATSQPCFSHNYRRSSENYNSSLHSTRKQPAKPWKRPVTASLQRMHPRVYRVEPVNFKELVQSLTGAPQDHERDQVHQVETKPLLKMQHGLVEVRQPLKIFHETTTQENPVAFDLSPSSSRFWEAFPLLSPANLSRW

SEQ ID NO: 2479 - protein, 133 aa, Glycine max
  misc_feature (1)..(133): Ceres CLONE ID no. 591984
  misc_feature: Utility: Useful for making smaller plants
MEAYYSGSYPASTKPISLLHTVRKVQAKPWKKAAVAPPAPTPIRVYKVDAINFRDLVQQLTGAPEFKPADQEQHQLFPSVAPIAATFVDTPQKPMLSSKDNIAASSTVSSATNWYQGAKSEPLEMNLSSPSSL

SEQ ID NO: 2480 - protein, 118 aa, Triticum aestivum
  misc_feature (1)..(118): Ceres CLONE ID no. 879739
  misc_feature: Utility: Useful for making smaller plants
MDHLLHHGHEMRRPSVPGHEAALRAVQKPPAKPWRAGGGLTPAPTPPKVYRVEPREFRDLVQRLTGAPAAAMARQHQHTHQLQRAPTQPVPVRPGGVEDAAAGGQMYAPWCSFPLMGP

SEQ ID NO: 2481 - DNA, 509 bp, Arabidopsis thaliana
  misc_feature (1)..(509): Ceres CLONE ID no. 266142
  misc_feature (1)..(509): Also known as  Ceres CDNA ID no. 23646375
gataaaccctagaagaagaagaagaagaagaagaagaagaagaagcaaaacctgtggagatcgagatgggaaatgagagcaagagcaatttgggaggaggaggaattagggcaaagatggagcactatgtctacagtggggagaagaagcacgttttggctgggatcgggattatctccatcatcttcggaatcccttggtatctaatgaatcaaggatcaaagcatcgttctcaccaagattacttggaaaaagctgataaagctcgaaaagctcgtctctcatcatcttcatcctcggataagtagtcatctccccccacttggatggagactctagtcaactacattttgtgaatggatccatacatcatcgttttccatgtctataaactcagccatgtctgttctagagtgtggttaagttcagatatgtatctttacactctacacttaggtttctttatcgaagatatgtaaatttgcgataagttaaaggattcatccttt

SEQ ID NO: 2482 - protein, 80 aa, Arabidopsis thaliana
  misc_feature: Utility: Useful for making smaller plants
MGNESKSNLGGGGIRAKMEHYVYSGEKKHVLAGIGIISIIFGIPWYLMNQGSKHRSHQDYLEKADKARKARLSSSSSSDK

SEQ ID NO: 2483 - protein, 88 aa, Brassica napus
  misc_feature (1)..(88): Ceres CLONE ID no. 1088403
  misc_feature: Utility: Useful for making smaller plants
MGNETKGNGASSLGGGGGFRAKMEHYVYSGEKKHVLAGIGIFTVIFGIPWYLMNRGSNNHRSHQDYMEKADKARKARLSSSPSPSSDK

SEQ ID NO: 2484 - protein, 63 aa, Arabidopsis thaliana
  misc_feature (1)..(63): Ceres CLONE ID no. 30167
  misc_feature: Utility: Useful for making smaller plants
MEHYVYSGEKKHVLVGIGIVTIIFGVPWYLMTQGSKHQSHQDYMDKADKARKARLSSSSSANK

SEQ ID NO: 2485 - protein, 63 aa, Arabidopsis thaliana; identical to SEQ ID NO: 2484
  misc_feature (1)..(63): Ceres CLONE ID no. 154257
  misc_feature: Utility: Useful for making smaller plants

SEQ ID NO: 2486 - protein, 65 aa, Zea mays
  misc_feature (1)..(65): Ceres CLONE ID no. 299189
  misc_feature: Utility: Useful for making smaller plants
MEHYLYSGEKKHVVAGIAIFAAVFGVPWYFMTRGAKHQSHQDYMEKANKARSERLSSGQSSALKE

SEQ ID NO: 2487 - protein, 77 aa, Glycine max
  misc_feature (1)..(77): Ceres CLONE ID no. 1072510
  misc_feature: Utility: Useful for making smaller plants
MNSNSNVGGGFRSRLNHYLYSGDKKHVFVGLTLITAVFTIPWYFMSRGTKHQSHQDYLEKADKARSQRLSSSSASAK

SEQ ID NO: 2488 - protein, 81 aa, Triticum aestivum
  misc_feature (1)..(81): Ceres CLONE ID no. 870660
  misc_feature: Utility: Useful for making smaller plants
MGGEGASSSGGGFRARIDHYLYSGEKKHVVAGIAIFAAIFGVPWYLMTRGAKHDSHQDYVERANKARSDRLSSGQPSSLKE

SEQ ID NO: 2489 - protein, 81 aa, Triticum aestivum; identical to SEQ ID NO: 2488
  misc_feature (1)..(81): Ceres CLONE ID no. 1053154
  misc_feature: Utility: Useful for making smaller plants

SEQ ID NO: 2490 - protein, 81 aa, Triticum aestivum
  misc_feature (1)..(81): Ceres CLONE ID no. 568747
  misc_feature: Utility: Useful for making smaller plants
MGGEGASSSGGGFRARIDHYLYSGEKKHVVAGIAIFAAIFGVPWYFMTRGAKHDSHQDYMERANKARSDRLSSGQPSSLKE

SEQ ID NO: 2491 - protein, 79 aa, Glycine max
  misc_feature (1)..(79): Ceres CLONE ID no. 636196
  misc_feature: Utility: Useful for making smaller plants
MNSNSNSNVGGGFRSRLNHYLYSGDKKHVFVGLTLITAVFTIPWYFMSRGTKHQSHQDYLEKADKARSQRLSSSSASAK

SEQ ID NO: 2492 - DNA, 1524 bp, Glycine max
  misc_feature (1)..(1524): Ceres CLONE ID no. 609573
  misc_feature (1)..(1524): Also known as  Ceres CDNA ID no. 23705836
atggagactggtggtggacgcgattctggcatgagttctgagactatcaattcctccactcaaagaacttcaatgagcaacgagagcgtttgcagcaccagcttcagccgtctctccttcgatctccctcctccttcttcttcccctgagaccctcttcgtcaaaccccaccgctcctccgacttcgcctactccgccatcctccgccgcaagtccgccctcaccttccgcgacttccacctcctccgccgcatcggcgccggcgacatcggcaccgtctacctctgccgtctccgccacgacgccggcgacgaggacgacgacgaggacccctgtttctacgcgatgaaggtggtggacaaggaggcggtggcgctgaagaagaaggcgcagagagcggagatggagaggaagattctgaagatggtggaccatccgttcctccctacgctctacgcggagttcgaggcttcgaatttctcatgcattgtgatggagtattgctccggtggggacttgcactcccttcaacacaaccaccccaataaccgattctctctctcctctgccaggttttacgcggctgaagtactggttgcgttggagtatctccacatgctgggaatcatctacagggatctgaagcccgaaaacgtgttggtcagatcagacggtcacatcatgctttccgacttcgatctctctctatgctccgatgctatcccagccgttgaatcccctgactgttcactggaccccgcattcgcacccgcgttacgctacactcgccagtactccacccccttctcctgcctctcgaaccgcgtattccggtccaggaaggtccagaccctccaacccaaccgcctcttcgtggccgaaccggtcggggcccgctcgtgctccttcgttgggacccacgagtacgtgtcgccggaagtggcctccgggaactcacacggcaatgccgtcgactggtggtccttcgggatattcatctacgagatggtgtacggtcgaacacccttcgcgggatcatcgaacgaggctacgctgcgaagcatcatcaaaaagcccctcgcatttcccacctccacgccctccagtacgcttgaaatgcacgcgcgggacctcatatcagggttgctcaacaaggacccgaaccgcaggctcgggtccaaacgaggctctgcggacgtcaaaaaacaccccttcttcgcggggctcaatctcgcgctcatccggacggtcacgccgccggaggttccatcactcagaaggcataaaacgacgccgttttactaccccgccaacgtaaataacagtagacagcagctaacggcgtttgattacttttgattaaaatccgacgatggtcgccccctgcgccacgccacgtgttcagtcggtgccccccagttttataattggcggatgggtgacttatgtgtatattttttagttgtcctttcttttttgtaacccttttttttaatataaaataacatagtttgatacttacgt

SEQ ID NO: 2493 - protein, 452 aa, Glycine max
  misc_feature (294)..(406): Pfam Name: Pkinase; Pfam Description: Protein kinase domain
  misc_feature (327)..(355): Pfam Name: Pkinase_Tyr; Pfam Description: Protein tyrosine kinase
  misc_feature: Utility: Useful for making smaller plants
METGGGRDSGMSSETINSSTQRTSMSNESVCSTSFSRLSFDLPPPSSSPETLFVKPHRSSDFAYSAILRRKSALTFRDFHLLRRIGAGDIGTVYLCRLRHDAGDEDDDEDPCFYAMKVVDKEAVALKKKAQRAEMERKILKMVDHPFLPTLYAEFEASNFSCIVMEYCSGGDLHSLQHNHPNNRFSLSSARFYAAEVLVALEYLHMLGIIYRDLKPENVLVRSDGHIMLSDFDLSLCSDAIPAVESPDCSLDPAFAPALRYTRQYSTPFSCLSNRVFRSRKVQTLQPNRLFVAEPVGARSCSFVGTHEYVSPEVASGNSHGNAVDWWSFGIFIYEMVYGRTPFAGSSNEATLRSIIKKPLAFPTSTPSSTLEMHARDLISGLLNKDPNRRLGSKRGSADVKKHPFFAGLNLALIRTVTPPEVPSLRRHKTTPFYYPANVNNSRQQLTAFDYF

SEQ ID NO: 2494 - protein, 445 aa, Glycine max
  misc_feature (1)..(445): Public GI no. 45271576
  misc_feature: Utility: Useful for making smaller plants
MSLETVNSNTQRTSLSSATESICSTSFSRLSFELLPSSSPESLSIKPHRSSDFAYSAIRKSGLTFRDFHLLRRIGSGDIGTVYLCRLRDSSVNYINDEDSSFYYAMKVVDKDAVALKKKSHRAEMERKILKMLDHPFLPSLYAEFEASNFSCIVMEFCSGGDLHSLRHRHPRNRFSLSSARFYAAEVLVALEYLHMLGIIYRDLKPENVLVRSDGHIMLSDFDLSLCSHAIPAVELSPDDPPLDVSCTRPHSISSPFKCLSKRLFRSRKVQTFQSNRLFVAEPVEARSCSFVGTHEYVSPEVASGNSHGNAVDWWSFGIFIYEMVYGRTPFAGPSNEATLRNIIKKPLSFPTATPSSTLEMHARDLISGLLNKDPNRRLGLKRGAADVKMHPFFVGLNLALIRMVTPPEVPGLRRNKTTPFVSGKDSNGNRSSSKQHPASSFDYF

SEQ ID NO: 2495 - protein, 460 aa, Glycine max
  misc_feature (1)..(460): Ceres CLONE ID no. 1361030
  misc_feature: Utility: Useful for making smaller plants
MLDTAERDSEVSLETVYSSTLGSSMSSESICSTSFSRLSFDLLPPSPETLSIKPHRSSDFAYSAAFRRKAALTFRDFHLLRRIGAGDIGTVYLCRLHNSNQLKNQDEDEEDVSCLYAMKVVDKDAVALKKKSQRAEMEKKILKMLDHPFLPTLYAEFEASHFSCIVMEFCSGGDLHSLRFKHPHNRFPLSSARFYAAEVLVALEYLHMLGIIYRDLKPENVLVRSDGHIMLSDFDLSLYSEAIPAVESSPDSLPSSNALPLPYAYTRSHSFMSPFSCFSNRSREVRTIEPNRLFVAEPVSARSCSFVGTHEYVSPKVASGRSHGNAVDWWSFGVFIYELIYGRTPYAGPSKEATLRNIVKKPLAFPTATPTSNLELHARDLISGLLNKDPARRLGSKRGAADVKKHPFFKGLNLALIRMQTPPEVPGSRRRTKTTSLYPVKGNGNNNHKQQQTASFDFYF

SEQ ID NO: 2496 - protein, 439 aa, Glycine max
  misc_feature (1)..(439): Public GI no. 1935918
  misc_feature: Utility: Useful for making smaller plants
MLLESDGEMSLETTNSPISSGTESCSSFSRLSFDAPPSTTAIIPEEESCLSLKPHRSSDFAYAEILRRRKHSLTFRDFRLMRRIGAGDIGTVYLCRLAGDQEESRSSYFAMKVVDNEALAMKKKMHRAEMEKKILKMLDHPFLPSLYAEFEASHFSCIVMEYCSGGDLHSLRHRQPQHRFSLSSARFYAAEVLVALEYLHMLGIIYRDLKPENILVRSDGHIMLSDFDLSLCSDSIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSPATMFELHARSLISGLLNKDPSTRLGSRRGAAEVKVHPFFKGLNFALIRTMTPPEVPSDVRRPKKSATFGGRSSKPAAFDFF

SEQ ID NO: 2497 - protein, 438 aa, Arabidopsis thaliana [sequence omitted]

SEQ ID NO: 2498 - protein, 461 aa, Arabidopsis thaliana
  misc_feature (1)..(461): Public GI no. 53749401
  misc_feature: Utility: Useful for making smaller plants
MAAAAASPTSSSSLPPKPPNSAAMLVEQQPLSYHDVDAASTPSSSVSSSSTASVGGRSSTFSLDSAATATPTSSPPRPHRAADVAWAPIRAAAAPLGPRDFTLVRRVGAGDIGTVYLCRLDGKRGAGSPSPCEYAMKVVDRRALAKKGKLGRAAAEKRVLRRLDHPFLPTMFADFDAGQDYSCVVMEFCPGGDLHSLRHRVPGRRFPVASARFYAAEVLLALEYLHMMGIVYRDLKPENVLIRADGHIMLTDFDLSLESTASPALEDARNGADDDPATPTCLPEVQLFRLRRWRRRAAPRRRPRFVAEPVDARSSSFVGTHEYVAPEVARGGGHGAGVDWWAYGVFLYELLYGRTPFVGATNEATLRNIVRRPLEFPPDAAGGGSPHDAAARDLIARLLDKDPRSRLGSRRGAADVKSHAFFKGLNFALLRSSAPPVVPPPAVAAAQCSKAADVPQLFDLF

SEQ ID NO: 2499 - DNA, 748 bp, Arabidopsis thaliana
  misc_feature (1)..(748): Ceres CLONE ID no. 4716
  misc_feature (1)..(748): Also known as  Ceres CDNA ID no. 23384157
acatgtacctaacttgttagtcaaacaaacaaaacaaaaaatccaagaagctttgaagaaccatggcgatgtctcatatccagcctgtgcttttcttccttgcatctctcttcttcttaccggctttgtgcagcgccatcgattttgaatattgcactaaaaatggacacgattacggtagcatctctcagatctgggtctctccctctgatgggcctcaggaaaacccaaccatcactatacatttattcggttctgcaagcaaagacatatccgcaggaacccttgtgtatgttacctatagatctggggattttacaggccttttaaaaacttacgacctatgtgatgtgagtgcatgtaaccctgaatatgtgattgaagctggcaccgactttgagttgactctttccgacgttctttatgttggttttgatgaggaaatcaagtattcggtatctttgcgcgaaaagacctcagaggagaagaatccaataataaaaatgtgtgtcgacttcaaagtacctcacccagcttttcctcctcctgcattggtctctatgtagtcaagttgacagatgaaaagatgtttccaagtctttgattatatgagtctcaacttgcatttccttttgtccctttttatatgttctccgacaaataaattaaaaccttggcttggttgatatgaaccaccatgtcttttctttgatttacttgttgatattaatcaaaaataaagttttct

SEQ ID NO: 2500 - protein, 88 aa, Arabidopsis thaliana
  misc_feature (24)..(71): Pfam Name: E1_DerP2_DerF2; Pfam Description: ML domain
  misc_feature (24)..(71): Pfam Name: E1_DerP2_DerF2; Pfam Description: ML domain
  misc_feature: Utility: Useful for making taller plants and plants with longer inflorescences
MAMSHIQPVLFFLASLFFLPALCSAIDFEYCTKNGHDYGSISQIWVSPSDGPQENPTITIHLFGSASKDISAEPLCMLPIDLGILQAF

SEQ ID NO: 2501 - DNA, 899 bp, Arabidopsis thaliana
  misc_feature (1)..(899): Ceres CLONE ID no. 23664
  misc_feature (1)..(899): Also known as  Ceres CDNA ID no. 23390268
aaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaagaaaaaaataattccaagtgatgttgtggaattattcaaaaaaagaaaaaaaactttattagatggctttact

SEQ ID NO: 2502 - protein, 211 aa, Arabidopsis thaliana
  misc_feature (60)..(82): Pfam Name: zf-C2H2; Pfam Description: Zinc finger, C2H2 type
  misc_feature: Utility: Useful for making taller plants and plants with longer inflorescences
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 2503 - DNA, 1249 bp, Arabidopsis thaliana
  misc_feature (1)..(1249): Ceres CLONE ID no. 3968
  misc_feature (1)..(1249): Also known as  Ceres CDNA ID no. 23367846
atcaccaaacattaagtagcactctttttcctctctatatctctcactcacactttttctctatatcttctcctcaacttggatatgggtgaagccgtagaggtcatgttcggaaatgggttcccggagattcacaaagccacatcacccactcaaaccctccactctaaccagcaagactgccattggtatgaagaaaccatcgatgatgatctcaagtggtcttttgccctcaacagtgttctccatcaaggaactagtgagtaccaagatattgctctgttggacaccaaacgttttggaaaggtgcttgtgattgatgggaaaatgcaaagtgctgagagagatgagtttatctaccatgaatgtttgatccatcccgctctccttttccatcccaaccccaagactgtgtttataatgggaggaggtgaaggctctgctgcaagagaaatactaaaacacacgacgatcgagaaagttgttatgtgtgatattgatcaggaagttgttgatttttgcagaagatttctgaccgttaacagcgatgctttctgtaacaagaagcttgaacttgtgatcaaagatgcaaaggctgaattagagaaaagggaagagaagtttgatatcatagtgggagatttagctgatccagtggaaggtggaccttgttatcagctctacaccaaatccttctaccaaaacattctcaaacccaagcttagccctaatggcatttttgtcacccaggctggaccagcaggaatattcactcataaggaagtcttcacatcaatctacaacaccatgaagcaagtcttcaagtacgtgaaggcttacacagcacatgtgccatcatttgcggacacatggggatgggtgatggcatcggaccatgagtttgacgttgaagttgatgaaatggatcgaagaatcgaagagagagttaacggagaattgatgtatctaaacgctccttctttcgtctctgctgctaccctcaacaaaaccatctctctcgcgctagagaaggagactgaagtttatagtgaagagaatgcgagattcattcatggtcatggtgtggcgtaccggcatatttaaagacgaaccggttcaatttcagtgtaataccaaacccatgtcacaaaaacaaaaagccggtttcttttctccgcacataaccgggtgttgtcttgaatcttgattactttggttcggttttattttctacattgcttttcgtttt

SEQ ID NO: 2504 - protein, 339 aa, Arabidopsis thaliana
  misc_feature (34)..(279): Pfam Name: Spermine_synth; Pfam Description: Spermine/spermidine synthase
  misc_feature: Utility: Useful for modifying seed structure and content
MGEAVEVMFGNGFPEIHKATSPTQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVNGELMYLNAPSFVSAATLNKTISLALEKETEVYSEENARFIHGHGVAYRHI

SEQ ID NO: 2505 - protein, 339 aa, Arabidopsis thaliana
  misc_feature (1)..(339): Public GI no. 18150168
  misc_feature: Utility: Useful for modifying seed structure and content
MGEAVEIMFGNGFPEIHKDTSPIQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVKGELMYLNAPSFVSAATLNKTISLALEKETEVYSEENARFIHGHGVAYRHI

SEQ ID NO: 2506 - protein, 349 aa, Arabidopsis thaliana
  misc_feature (1)..(349): Public GI no. 40788039
  misc_feature: Utility: Useful for modifying seed structure and content
MGSEALEFFSCANNNNNNNGFSYEPKKNIIMEETDNLSINIHDGSWFEEEIDVDLKWSFALNSVLHKGTSEYQDIALLDTKHFGKILVIDGKMQSAEVDEFIYHECLIHPALLCHPNPKNVFIMGGGEGSAAREALRHKSMEKVVMCDIDKEVVDFCKKHLTANHEAFLNKKLNLVINDAKAELEQRQEKFDIIVGDLADPVEGGPCYQLYTKSFYQNILKPKLNDTGIFVTQAGPAGVFTHKEVFSSIYNTTKQVFKYVLAYTAHVPSFADTWGWVMASDKPFCLDAGKLDKKIAERIEGELLYLNGASFFSSTILNKTVAKTLKNESHVYAEDDARFIHGHGLGFRN

SEQ ID NO: 2507 - protein, 344 aa, Arabidopsis thaliana
  misc_feature (1)..(344): Public GI no. 50252842
  misc_feature: Utility: Useful for modifying seed structure and content
MVGAVQEGIVREMNGGFEVMSGYDRSSMAPKQQQREEESKWYEEEIDDDLKLCYALNSVLHRGASKYQEIALIDTKHFGKALIIDGKMQSTEVDEFIYHESLIHPPLLFHPNPKTVFIMGGGEGSAAREVLRHNTVHRVVMCDIDQEVVDFCRTYLTVNWDAFASDKLCLIINDARAELEKSREKFDVIVGDLADPVEGGPCYQLYTKSFYQHIVKPKLNDRGVFVTQAGPAGVLTHKEVFSSIYNTLRHVFKYVKAYTAHVPSFADTWGWVMASDYPFSMNAQQINERIKERIDGELVYLSGESLISSTILNKSVYQSLLNETHVYTEDDARFIYGHGRARCA

SEQ ID NO: 2508 - protein, 380 aa, Arabidopsis thaliana
  misc_feature (1)..(380): Public GI no. 38602797
  misc_feature: Utility: Useful for modifying seed structure and content
FSIKGNGIGNGNGHCNGYSNGHGHCINGYSNGISASVSSNGVSHLPYSNGNTVHHSNSNGHIHTSPSFGDGRRRCFWYEEEIEDDLRWCFALNRILHTGVSEYQDIALIDTRPFGKALVIDGKMQSTEVDEFIYHESLVHPALVYHSQPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLEAGEIDDRIKQRIKGELQFLDGQTFLVAATLNKSVRKSLSKETHVYTEETARFIHGHGKASYQ

SEQ ID NO: 2509 - DNA, 877 bp, Arabidopsis thaliana
  misc_feature (1)..(877): Ceres CLONE ID no. 98850
  misc_feature (1)..(877): Also known as  Ceres CDNA ID no. 23448883
agattaggattaaattagggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgagatagaagcgctgttcaagccggagaaacctcaatgttttgaactcgatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttctcc

SEQ ID NO: 2510 - protein, 192 aa, Arabidopsis thaliana; identical to SEQ ID NO: 580
  misc_feature (9)..(59): Pfam Name: SRF-TF; Pfam Description: SRF-type transcription factor (DNA- binding and dimerisation domain)
  misc_feature (113)..(162): Pfam Name: K-box; Pfam Description: K-box region
  misc_feature (9)..(59): Pfam Name: SRF-TF; Pfam Description: SRF-type transcription factor (DNA- binding and dimerisation domain)
  misc_feature (113)..(162): Pfam Name: K-box; Pfam Description: K-box region

SEQ ID NO: 2511 - protein, 196 aa, Arabidopsis thaliana; identical to SEQ ID NO: 579
  misc_feature (1)..(196): Ceres CLONE ID no. 92459

SEQ ID NO: 2512 - protein, 196 aa, Arabidopsis thaliana; identical to SEQ ID NO: 579
  misc_feature (1)..(196): Public GI no. 21617978

SEQ ID NO: 2513 - protein, 205 aa, Arabidopsis thaliana; identical to SEQ ID NO: 583
  misc_feature (1)..(205): Public GI no. 51968502

SEQ ID NO: 2514 - protein, 198 aa, Arabidopsis thaliana
  misc_feature (1)..(198): Public GI no. 32402402
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 2515 - protein, 200 aa, Arabidopsis thaliana
  misc_feature (1)..(200): Public GI no. 29165411
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 2516 - protein, 197 aa, Brassica napus
  misc_feature (1)..(197): Ceres CLONE ID no. 1065387
MGRKKLEIKRIENKSSRQVTFSKRRNGLIEKARQLSVLCDASVALLVVSASGKLYSFSSGDNLVKILDRYGKQHDDDLKALDRQSKALDCGSHHELLELVESKLEESNVDNVSVGSLVQLEEHLENALSVTRARKTELMLKLVENLKEKEKLLEEENHVLASQMEKSNLVRAEADNMDVSPGQISDINLPVTLPLLN

SEQ ID NO: 2517 - protein, 197 aa, Brassica napus; identical to SEQ ID NO: 2516
  misc_feature (1)..(197): Public GI no. 17933450

SEQ ID NO: 2518 - protein, 196 aa, Brassica napus
  misc_feature (1)..(196): Public GI no. 31580813
MGRKKLEIKRIENKSSRQVTFSKRRNGLIEKARQLSVLCDASVALLVVSASGKLYNFSAGDNLVKILDRYGKQHADDLKALDLQSKAPKYGSHHELLELVESKLVESNSDVSVDSLVQLEDHLETALSVTRARKTELMLKLVDSLKEKEKLLKEENQGLASQMEKNNLAGAEADKMEMSPGQISDINRPVTLRLLY

SEQ ID NO: 2519 - protein, 196 aa, Brassica napus
  misc_feature (1)..(196): Public GI no. 17933458
MGRKKLEIKRIEKNSSRQVTFCKRRNGLIEKARQLSVLCEASVGLLVVSASDKLYSFSSGDRLEKILDRYGKKHADDLNALDLQSKSLNYSSHHELLELVESKLVESIDDVSVDSLVELEDHLETALSVTRARKAELMLKLVESLKEKENLLKEENQVLASQIEKKNLEGAEADNIEMSSGQISDINLPVTLPLLN

SEQ ID NO: 2520 - protein, 197 aa, Brassica napus
  misc_feature (1)..(197): Public GI no. 34591565
MGRKKLEIKRIENKSSRQVTFSKRRNGLIEKARQLSVLCDASVALLVVSASGKLYNFSAGDDLVKVIDRYGEQHADDDRKALDLQSEAPKYGSHHELLELVESKLVESNSDVSVDSLVQLENHLETALSVTRARKTELLLKLVDSLKEKEKLLKEENQGLASQMEKNNLAGAEADKMEVSPGQISDINCPVTLPLLY

SEQ ID NO: 2521 - protein, 196 aa, Brassica napus
  misc_feature (1)..(196): Public GI no. 17933456
MGRKKLEIKRIENKSSRQVTFSKRRNGLIEKARQLSVLCDASVALLVVSASGKLYNFSAGDDLVKIVDRYGKQHADDRKALDLQSEAPKYGSHHELLELVESKLVESNSDVSVDSLVQLENHLETALSVTRARKTELLLKLVDSLKEKEKLLKEENQGLASQMEKNNLAGAEADKMEVSPGQISDINCPVTLPLLY

SEQ ID NO: 2522 - protein, 196 aa, Brassica napus; identical to SEQ ID NO: 2521
  misc_feature (1)..(196): Ceres CLONE ID no. 1091989

SEQ ID NO: 2523 - protein, 196 aa, Arabidopsis thaliana
  misc_feature (1)..(196): Ceres CLONE ID no. 39347
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN
